US008679502B2

(12) United States Patent
Takada et al.

(10) Patent No.: US 8,679,502 B2

(45) Date of Patent: Mar. 25, 2014

(54) MONOCLONAL ANTIBODIES THAT BIND TO HGM-CSF AND MEDICAL COMPOSITIONS COMPRISING SAME

(75) Inventors: Kenzo Takada, Sapporo (JP); Kantou Nakajima, Sapporo (JP); Barbara Kistler, Ingelheim Am Rhein (DE); John Park, Ingelheim Am Rhein (DE)

(73) Assignees: Evec Inc., Sapporo (JP); Boehringer Ingelheim International GmbH, Ingelheim am Rhein (DE)

( * ) Notice: Subject to any disclaimer, the term of this patent is extended or adjusted under 35 U.S.C. 154(b) by 741 days.

(21) Appl. No.: 12/681,396

(22) PCT Filed: Nov. 12, 2008

(86) PCT No.: PCT/US2008/012680

§ 371 (c)(1), (2), (4) Date: Apr. 2, 2010

(87) PCT Pub. No.: WO2009/064399

PCT Pub. Date: May 22, 2009

(65) Prior Publication Data

US 2011/0182905 A1 Jul. 28, 2011

(30) Foreign Application Priority Data

Nov. 13, 2007 (JP) ................................ 2007-294945
Feb. 14, 2008 (WO) .................. PCT/JP2008/052471

(51) Int. Cl.

| | |
|---|---|
| ***A61K 39/395*** | (2006.01) |
| ***C12N 5/00*** | (2006.01) |
| ***C12N 15/00*** | (2006.01) |
| ***C07K 16/22*** | (2006.01) |
| ***C07H 21/00*** | (2006.01) |

(52) U.S. Cl.

USPC ..................... 424/145.1; 435/320.1; 435/326; 435/335; 435/69.1; 530/388.23; 536/23.53

(58) Field of Classification Search

None

See application file for complete search history.

(56) References Cited

U.S. PATENT DOCUMENTS

| | | | | |
|---|---|---|---|---|
| 5,662,138 | A | 9/1997 | Wang | |
| 5,919,910 | A * | 7/1999 | Hughes-Jones | 530/387.3 |
| 7,084,257 | B2 | 8/2006 | Deshpande et al. | |
| 7,138,501 | B2 | 11/2006 | Ruben et al. | |
| 7,193,069 | B2 | 3/2007 | Isogai et al. | |
| 7,229,784 | B2 | 6/2007 | Holtzman et al. | |
| 7,282,205 | B2 | 10/2007 | Schofield et al. | |
| 7,326,414 | B2 | 2/2008 | Bedian et al. | |
| 7,361,740 | B2 | 4/2008 | Hinton et al. | |
| 7,455,836 | B2 | 11/2008 | Hamilton et al. | |
| 7,935,795 | B2 | 5/2011 | Nakajima | |
| 2003/0103968 | A1 | 6/2003 | Amelsberg et al. | |
| 2008/0317757 | A1 | 12/2008 | Nakajima | |
| 2010/0010202 | A1 | 1/2010 | Kucherlapati et al. | |
| 2010/0215650 | A1 | 8/2010 | Bebbington et al. | |

FOREIGN PATENT DOCUMENTS

| | | | |
|---|---|---|---|
| EP | 0265384 | A | 4/1988 |
| EP | 0499161 | A2 | 3/1995 |
| EP | 2 101 780 | A2 | 9/2009 |
| EP | 2 402 013 | A1 | 1/2012 |
| JP | 5-176792 | A | 7/1993 |
| UA | 89364 | C2 | 10/2006 |
| WO | WO 91/01330 | A1 | 2/1991 |
| WO | WO 92/08474 | A2 | 5/1992 |
| WO | WO 03/068924 | A | 8/2003 |
| WO | WO 2005/055946 | A2 | 6/2005 |
| WO | WO 2005/105844 | A2 | 11/2005 |
| WO | WO 2006/111353 | A | 10/2006 |
| WO | WO 2006/122797 | A | 11/2006 |
| WO | WO 2007/049472 | A1 | 5/2007 |
| WO | WO 2007/092939 | A | 8/2007 |
| WO | WO 2008/064321 | A2 | 5/2008 |
| WO | WO 2009/038760 | A2 | 3/2009 |
| WO | WO 2009/064399 | A1 | 5/2009 |

OTHER PUBLICATIONS

Paul, W.E. Fundamental Immunology, Third Edition (textbook), "Fv Structure and Diversity in Three Dimensions" pp. 292-295; Raven Press, New York (1993).*

Vajdos et al. Comprehensive functional maps of the antigen-binding site of an anti-ErbB2 antibody obtained with shotgun scanning mutagenesis, J. Mol. Biol. 320(2):415-428 (Jul. 5, 2002).*

Houdebine, The methods to generate transgenic animals and to control transgene expression. Journal of Biotechnology, 98:145-160 (2002).*

Phillips, A., The challenge of gene therapy and DNA delivery. J Pharm. Pharmacology 53: 1169-1174 ( 2001).*

Bigazzi et al. Introduction to review series on animal models of human disease. Clinical Immunology and Immunopathology, vol. 74/No. 1, p. 1 (Jan. 1995).*

Bretag, A. Too much hype, not enough hope: Are balanced reporting and proper controls too much to expect from therapeutic studies in animal models of neuromuscular diseases that presage clinical trials in humans? Neuromuscular Disorders 17:203-205 (2007).*

Declaration of Gary P. Anderson, Ph.D. filed in U.S. Appl. No. 09/851,230 dated Aug. 16, 2007.

Campbell et al., Protection from collagen-induced arthritis in granulocyte-macrophage colony-stimulating factor-deficient mice. J Immunol. Oct. 1, 1998;161(7):3639-44.

Hercus et al., Specific human granulocyte-macrophage colony-stimulating factor antagonists. Proc Natl Acad Sci U S A. Jun. 21, 1994;91(13):5838-42.

(Continued)

*Primary Examiner* — Elizabeth C Kemmerer

*Assistant Examiner* — Regina M Deberry

(74) *Attorney, Agent, or Firm* — Wolf, Greenfield & Sacks, P.C.

(57) ABSTRACT

Disclosed herein are anti-hGM-CSF monoclonal antibodies and antigen-binding fragments of such antibodies, with improved neutralizing capacity to hGM-CSF activity. Pharmaceutical compositions comprising such an antibody or antigen-binding fragment are also provided. The present invention is useful for the treatment of various diseases that are associated with aberrant expression of hGM-CSF.

64 Claims, 7 Drawing Sheets

(56) References Cited

OTHER PUBLICATIONS

Svenson et al., Antibody to granulocyte-macrophage colony-stimulating factor is a dominant anti-cytokine activity in human IgG preparations. Blood. Mar. 15, 1998;91(6):2054-61.
Vlahos et al., GM-CSF is a pathogenic mediator in experimental COPD. Proc Am Thorac Soc 2005;2:A143. Abstract Only.
Vlahos et al., Neutralizing granulocyte/macrophage colony-stimulating factor inhibits cigarette smoke-induced lung inflammation. Am J Respir Crit Care Med. Jul. 1, 2010;182(1):34-40. Epub Mar. 4, 2010.
Xing et al., Human upper airway structural cell-derived cytokines support human peripheral blood monocyte survival: a potential mechanism for monocyte/macrophage accumulation in the tissue. Am J Respir Cell Mol Biol. Feb. 1992;6(2):212-8.
International Preliminary Report on Patentability for PCT/US2008/012680 mailed May 27, 2010.
Extended European Search Report for EP 06811775 3 mailed Feb. 10, 2009.
International Search Report for PCT/JP2006/320502 mailed Dec. 26, 2006.
International Preliminary Report on Patentability for PCT/JP2006/320502 mailed Jun. 19, 2008.
Internationl Search Report for PCT/JP2008/052471 mailed Mar. 18, 2008.
Genbank Submission; NIH/NCBI, Accession No. AAA52578.1; Lee et al.; Nov. 8, 1994.
Genbank Submission; NIH/NCBI, Accession No. CAA26820.1; Gough et al.; Sep. 24, 2008.
Genbank Submission; NIH/NCBI, Accession No. NP_000749; Johnson et al.; Dec. 13, 2010.
Genbank Submission; NIH/NCBI, Accession No. NP_001028121; Hutchinson et al.; Sep. 9, 2010.
Genbank Submission; NIH/NCBI, Accession No. NP_034099; Choi et al.; Dec. 5, 2010.
Genbank Submission; UniProtein, Accession No. B0KWQ4; Antonellis et al.; Nov. 30, 2010.
BLAST (Basic Local Alignment Search Tool) results for comparison of sequences AAA52578.1 and CAA26820.1. Search performed on Mar. 9, 2010. 3 pages.
Brown et al., Mapping of human granulocyte-macrophage-colony-stimulating-factor domains interacting with the human granulocyte-macrophage-colony-stimulating-factor-receptor alpha-subunit. Eur J Biochem. Nov. 1, 1994;225(3):873-80.
Colman, Effects of amino acid sequence changes on antibody-antigen interactions. Res Immunol. Jan. 1994;145(1):33-6.
Dempsey et al., Monoclonal antibodies that recognize human granulocyte-macrophage colony-stimulating factor and neutralize its bioactivity in vitro. Hybridoma. Dec. 1990;9(6):545-58. Abstract only.
Enzler et al., Chapter 21. Granulocyte-macrophage colony-stimulating factor, in: Thomson et al., eds., The Cytokine Handbook, 4th Edition, Elsevier Science Ltd. 2003:503-524.
Green, Antibody engineering via genetic engineering of the mouse: XenoMouse strains are a vehicle for the facile generation of therapeutic human monoclonal antibodies. J Immunol Methods. Dec. 10, 1999;231(1-2):11-23.
Griffiths et al., Strategies for selection of antibodies by phage display. Curr Opin Biotechnol. Feb. 1998;9(1):102-8.
Hoogenboom, Designing and optimizing library selection strategies for generating high-affinity antibodies. Trends Biotechnol. Feb. 1997;15(2):62-70.
Nice et al., Human granulocyte-macrophage colony-stimulating factor (hGM-CSF): identification of a binding site for a neutralizing antibody. Growth Factors. 1990;3(2):159-69. Abstract only.
Paul, Fundamental immunology, 3rd Edition, 1993:292-295, under the heading "Fv structure and diversity in three dimensions.".
Rathanaswami et al., Demonstration of an in vivo generated sub-picomolar affinity fully human monoclonal antibody to interleukin-8. Biochem Biophys Res Commun. Sep. 9, 2005;334(4):1004-13.
Rudikoff et al., Single amino acid substitution altering antigen-binding specificity. Proc Natl Acad Sci U S A. Mar. 1982;79(6):1979-83.
Scott et al., A phase i dose-escalation study of bibh 1 in patients with advanced or metastatic fibroblast activation protein positive cancer. 2001 ASCO Annual Meeting. Proc Am Soc Clin Oncol. 2001;20: Abstract 1028.
Shanafelt et al., The amino-terminal helix of GM-CSF and IL-5 governs high affinity binding to their receptors. EMBO J. Dec. 1991;10(13):4105-12.
Short et al., Contribution of antibody heavy chain CDR1 to digoxin binding analyzed by random mutagenesis of phage-displayed Fab 26-10. J Biol Chem. Dec. 1, 1995;270(48):28541-50.
Veracity, TGN1412 drug trial update: One patient may lose fingers and toes due to drug side effects. Natural News.com. May 8, 2006. Retrieved Mar. 3, 2010 from http://www.naturalnews.com/019371.html.
Wilkinson, Pharmacokinetics: The dynamics of drug absorption, distribution, and elimination. Chapter 1 in Goodman & Gilman's The Pharmacological Basis of Therapeutics. 10th Edition. McGraw-Hill, New York, NY, 2001:3-29.
Bischof RJ et al., Exacerbation of acute inflammatory arthritis by the colony-stimulating factors CSF-1 and granulocyte macrophage (GM)-CSF: evidence of macrophage infiltration and local proliferation. Clin Exp Immunol. 119(2):361-367 (2000).
Bonfield TL et al., Anti-GM-CSF titer predicts response to GM-CSF therapy in pulmonary alveolar proteinosis. Clin Immunol. 105(3):342-350 (2002).
Bozinovski S et al., Innate immune response to LPS in mouse lung are suppressed and reversed by neutralization of GM-CSF via repression of TLR-4. Am J Physiol Lung Cell Mol Physiol. 286(4):L877-L885 (2004).
Bratton DL et al., Granulocyte macrophage colony-stimulating factor contributes to enhanced monocyte survival in chronic atopic dermatitis. J. Clin Invest. 95(1):211-218 (1995).
Campbell IK et al., Granulocyte-macrophage colony stimulating factor exacerbates collagen induced arthritis in mice. Ann Rheum Dis. 56:364-368 (1997).
Cates EC et al., Intranasal exposure of mice to house dust mite elicits allergic airway inflammation via a GM-CSF-mediated mechanism. J Immunol. 173:6384-6392 (2004).
Cook AD et al., Blockade of collagen-induced arthritis post-onset by antibody to granulocyte-macrophage colony-stimulating factor (GM-CSF): requirement for GM-CSF in the effector phase of disease. Arthritis Res. 3(5):293-298 (2001).
Fleetwood AJ et al., Functions of granulocyte-macrophage colony-stimulating factor. Crit Rev Immunol. 25(5):405-428 (2005).
Gorny MK et al., Generation of human monoclonal antibodies to human immunodeficiency virus. Proc Natl Acad Sci USA 86(5):1624-1628 (1989).
Hamilton JA, GM-CSF in inflammation and autoimmunity. Trends Immunol. 23(8):403-408 (2002).
Ohta K et al., Diesel exhaust particulate induces airway hyperresponsiveness in a murine model: essential role of GM-CSF. J Allergy Clin Immunol. 104(5):1024-1030 (1999).
Schön M et al., Critical role of neutrophils for the generation of psoriasiform skin lesions in flaky skin mice. J Invest Dermatol. 114(5):976-983 (2000).
Song XY et al., Coming of age: anti-cytokine therapies. Mol Interv. 2(1):36-46 (2002).
Weiner LM, Fully human therapeutic monoclonal antibodies. J Immunother. 29(1):1-9 (2006).
Yamashita N et al., Attenuation of airway hyperresponsiveness in a murine asthma model by neutralization of granulocyte-macrophage colony-stimulating factor (GM-CSF). Cell Immunol. 219(2):92-97 (2002).
Yang YH et al., Dependence of interleukin-1-induced arthritis on granulocyte-macrophage colony-stimulating factor. Arthritis Rheum. 44(1):111-119 (2001).
Extended European Search Report for EP 12181684.7 mailed Nov. 20, 2012.
Extended European Search Report for EP 12192975.6 mailed Dec. 21, 2012.

(56) References Cited

OTHER PUBLICATIONS

Sundaram et al., "Monoclonal antibodies and their engineered fragments." The Biomedical Engineering Handbook, Second Edition. CRC Press.2000. pp. 102-1-102-20.

Kozlov, Granulocyte Colony-Stimulating Factor (G-CSF): Physiological Activity, Pathophysiological and Therapeutic Questions. Cytokines & Inflammation. 2004; 3(2):3-15. Full Russian text; English abstract on p. 15.

* cited by examiner

MONOCLONAL ANTIBODIES THAT BIND TO HGM-CSF AND MEDICAL COMPOSITIONS COMPRISING SAME

FIELD OF THE INVENTION

This invention relates to monoclonal antibodies that bind human Granulocyte-Macrophage Colony Stimulating Factor (also referred to as "hGM-CSF") and neutralize hGM-CSF activity, compositions that include one or more of such monoclonal antibodies and methods in which such monoclonal antibodies and compositions are used.

SEQUENCE LISTING

The sequence listing filed electronically as a text file entitled "B1204.70004PCT_ST25.txt", created on Nov. 10, 2008 and modified on Nov. 11, 2008, comprising 1.048 megabytes (MB) of information, is hereby incorporated by reference in its entirety.

BACKGROUND OF THE INVENTION

Granulocyte-Macrophage Colony Stimulating Factor (GM-CSF) was identified as a humoral factor that promotes proliferation of bone marrow granulocyte and macrophage progenitor cells and promotes formation of granulocyte and macrophage colonies in vitro.

GM-CSF is now known to be a stimulating factor for a wide range of cell types. It induces differentiation and proliferation of granulocyte-macrophage lineage blood cells, augments functions of antigen-presenting cells, maintains functions of some kinds of epithelial cells and induces functions of alveolar macrophages (e.g., enhances surfactant catabolism, bactericidal function, and Fc receptor expression). The Cytokine Handbook, 4th edition, Thomson, A. et al. (eds.), Academic Press, 2003.

GM-CSF is known to cause various diseases, including 1) allergic diseases such as asthma, atopy, and pollinosis, 2) graft rejection, and graft-versus-host disease (GVHD), and 3) autoimmune diseases, such as rheumatoid arthritis.

For example, human GM-CSF (hGM-CSF) is over-expressed in the lungs of allergic subjects and in the joints of rheumatoid arthritis patients; hGM-CSF mRNA is over-expressed in skin of allergic subjects. It has also been reported that the survival of monocytes, which are inflammation-inducing cells in atopic dermatitis, is enhanced by GM-CSF production. Bratton, D. L. et al., Granulocyte macrophage colony-stimulating factor contributes to enhanced monocyte survival in chronic atopic dermatitis. J. Clin. Invest., 95: 211-218, 1995.

In addition, it has been shown that GM-CSF stimulates proliferation of leukemic cells. Therefore, GM-CSF is considered to be a factor that causes leukemia.

It would be useful to have approaches to treating diseases and conditions caused by human GM-CSF. One approach to therapy for such diseases and conditions is to bind hGM-CSF and inhibit its biological activity. This might be done, for example, by administering anti-hGM-CSF monoclonal antibodies that have high affinity and sufficient neutralizing activity against hGM-CSF but do not induce immunological reaction.

However, hGM-CSF-inhibiting antibodies reported to date do not have sufficient neutralizing activity against hGM-CSF. Further, it seems very likely that presently-available anti-hGM-CSF monoclonal antibodies will induce an unwanted immune response in recipients. Polyclonal antibody and monoclonal antibody are generally derived from experimental animals, such as mice, rabbits and caprines. However, the obtained antibodies have a sequence characteristic of the kind of animals used for their production. If they are administered to humans, the human immune system might recognize the antibodies as foreign, and then, human anti-animal antibody response (that is, antibody produces its own antibody) may be caused.

In addition, long-term administration is necessary for treatment of such diseases and problems might arise as a result, such as safety problems that might be caused by small amounts of impurities in medicines administered. Antibodies with greater neutralizing activity than those presently available would be valuable as therapeutics from the view point of effectiveness, safety, and medical expense.

SUMMARY OF THE INVENTION

The invention is based at least in part on the development by the inventors of certain monoclonal anti-human GM-CSF antibodies that are characterized by their extremely high neutralizing activity toward hGM-CSF. Surprisingly, the neutralizing activity of these antibodies is greater than might be expected based upon their binding affinities for hGM-CSF. Two of these monoclonal anti-hGM-CSF antibodies are referred to herein as EV1018 and EV1019.

In one aspect, the invention provides anti-hGM-CSF antibodies and fragments thereof that bind to and neutralize hGM-CSF.

In one embodiment, an isolated anti-hGM-CSF monoclonal antibody or antigen-binding fragment thereof is provided, wherein the antibody or antigen-binding fragment thereof recognizes ELYK (SEQ ID NO: 2) and TMMASHYKQH (SEQ ID NO: 3) in hGM-CSF, the amino acid sequence of which is as set forth in SEQ ID NO: 1. In one embodiment, the antibody comprises:

(a) a heavy chain comprising a consensus $V_H$-CDR1-containing sequence, a consensus $V_H$-CDR2-containing sequence, and a consensus $V_H$-CDR3-containing sequence, wherein:

(i) the consensus $V_H$-CDR1-containing sequence is $FTFSX_1X_2MH$ (SEQ ID NO: 314), wherein $X_1$ is Y or H, and $X_2$ is G or A, (ii) the consensus $V_H$-CDR2-containing sequence is $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, and (iii) the consensus $V_H$-CDR3-containing sequence is $EX_nX_9GX_{10}X_nX_nDX_n$ (SEQ ID NO: 316), wherein each $X_n$ independently is any naturally occurring amino acid, $X_9$ is M or V, and $X_{10}$ is A or G; and (b) a light chain comprising a consensus $V_L$-CDR1-containing sequence, a consensus $V_L$-CDR2-containing sequence, and a consensus $V_L$-CDR3-containing sequence, wherein:

(i) the consensus $V_L$-CDR1-containing sequence is $X_nGNX_nX_nNIGSX_{11}AVG$ (SEQ ID NO: 317), wherein each $X_n$ independently is any naturally occurring amino acid, and $X_{11}$ is H or Y, (ii) the consensus $V_L$-CDR2-containing sequence is $GX_{12}SPX_{13}SG$ (SEQ ID NO: 318), wherein $X_{12}$ is R or K, and $X_{13}$ is A or P, and (iii) the consensus $V_L$-CDR3-containing sequence is $STWDSX_{14}LSAVX_{15}$ (SEQ ID NO: 319), wherein $X_{14}$ is R or S, and $X_{15}$ is V or L;

and the antibody or antigen-binding fragment thereof specifically binds hGM-CSF.

In one embodiment, the antibody comprises:

(a) a heavy chain comprising $V_H$-CDR1, $V_H$-CDR2 and $V_H$-CDR3, wherein:

(i) $V_H$-CDR1 has an amino acid sequence selected from SYGMH (SEQ ID NO: 10) and SHAMH (SEQ ID NO: 333), (ii) $V_H$-CDR2 has an amino acid sequence selected from LTYHHGNRKFYADSVRG (SEQ ID NO: 5) and VIWHDGSKKYYADSVKG (SEQ ID NO: 334), and (iii) $V_H$-CDR3 has an amino acid sequence selected from ESMGAINDN (SEQ ID NO: 6) and EWVGGTCDS (SEQ ID NO: 335); and (b) a light chain comprising $V_L$-CDR1, $V_L$-CDR2 and $V_L$-CDR3, wherein:

(i) $V_L$-CDR1 has an amino acid sequence selected from IGNNNNIGSHAVG (SEQ ID NO: 7) and SGNSSNIGSYAVG (SEQ ID NO: 330), (ii) $V_L$-CDR2 has an amino acid sequence selected from GRSPPS (SEQ ID NO: 8) and GKSPAS (SEQ ID NO: 331), and (iii) $V_L$-CDR3 has an amino acid sequence selected from STWDSSLSAVV (SEQ ID NO: 9) and STWDSRLSAVL (SEQ ID NO: 332), and the antibody or antigen-binding fragment thereof specifically binds hGM-CSF.

For example, the antibody or antigen-binding fragment thereof described above binds to human GM-CSF with a $K_D$ of less than 400 pM, more preferably with a $K_D$ of less than 160 pM.

The antibody or antigen-binding fragment thereof described herein neutralizes hGM-CSF activity, such that the antibody or antigen-binding fragment thereof has an $IC_{50}$ value of less than 100 pM (e.g., less than 30 pM, less than 20 pM) as determined in a TF-1 proliferation assay at ED80 as described herein.

In any of the embodiments, the antibody or antigen-binding fragment thereof can comprise a heavy chain that is gamma 1 ($\gamma_1$), gamma 2 ($\gamma_2$), gamma 3 ($\gamma_3$) or gamma 4 ($\gamma_4$). A heavy chain can be selected from SEQ ID NOs: 10-33, 38-80, and 160-183 and 222-245.

In any of the embodiments, the antibody or antigen-binding fragment thereof can comprise a light chain which is a lambda light chain. In some embodiments, the lambda light chain can contain one or both of the following amino acid substitutions: R100G and A153G, as referenced via the wild type sequence. In one embodiment a light chain can be selected from SEQ ID NOs: 34-37 and 202-221. The light chain can be a lambda light chain or a kappa light chain. In some embodiments, the heavy chain is gamma 1 ($\gamma_1$), gamma 2 ($\gamma_2$), gamma 3 ($\gamma_3$) or gamma 4 ($\gamma_4$) and the light chain is a lambda light chain. In any of the embodiments, the heavy chain can contain one or more amino acid substitutions selected from the group consisting of: Q3E, T97A, T97V, N95D, N95E, N95K, N95Q, N93Q/N95T, K144R, L164A, and L165A, as referenced via the wild type sequence. In some embodiments, the antibody or antigen-binding fragment thereof comprises a heavy chain containing one or more amino acid substitutions selected from the group consisting of: Q3E, T97A, T97V, N95D, N95E, N95K, N95Q, N93Q/N95T, K144R, L164A, and L165A, and a light chain containing one or both of the following amino acid substitutions: R100G and A153G.

The antibody or antigen-binding fragment thereof as described herein can include a $V_H$-CDR1 having an amino acid sequence SYGMH (SEQ ID NO: 4) or SHAMH (SEQ ID NO: 333). The antibody or antigen-binding fragment thereof as described herein can include a $V_H$-CDR2 having an amino acid sequence LTYHHGNRKFYADSVRG (SEQ ID NO: 5) or VIWHDGSKKYYADSVKG (SEQ ID NO: 334). The antibody or antigen-binding fragment thereof as described herein can include a $V_H$-CDR3 having an amino acid sequence ESMGAINDN (SEQ ID NO: 6) or EWVGGTCDS (SEQ ID NO: 335). The antibody or antigen-binding fragment thereof as described herein can include a $V_L$-CDR1 having an amino acid sequence IGNNNNIGSHAVG (SEQ ID NO: 7) or SGNSSNIGSYAVG (SEQ ID NO: 330). The antibody or antigen-binding fragment thereof as described herein can include a $V_L$-CDR2 having an amino acid sequence GRSPPS (SEQ ID NO: 8) or GKSPAS (SEQ ID NO: 331). The antibody or antigen-binding fragment thereof as described herein can include a $V_L$-CDR3 having an amino acid sequence STWDSSLSAVV (SEQ ID NO: 9) or STWDSRLSAVL (SEQ ID NO: 332).

In some embodiments, the antibody or antigen-binding fragment thereof that specifically binds hGM-CSF comprises 6 different CDRs, the sequences of which are set forth as SEQ ID NOs: 4-9.

In some embodiments, the antibody or antigen-binding fragment thereof that specifically binds hGM-CSF comprises 6 different CDRs, the sequences of which are set forth as SEQ ID NOs: 330-335.

In any of the embodiments provided herein, the antibody can include a heavy chain that is gamma 1 ($\gamma_1$), gamma 2 ($\gamma_2$), gamma 3 ($\gamma_3$) or gamma 4 ($\gamma_4$), and a light chain that is kappa or lambda.

In some embodiments, the antibody or antigen-binding fragment described herein may further comprise a signal sequence, such as those shown in SEQ ID NOs: 324, 325 and 326.

Embodiments drawn to wild-type as well as its variants are included in the invention. In some embodiments, the antibody or fragment thereof comprises a heavy chain that is SEQ ID NO: 10 or a variant thereof selected from SEQ ID NOs: 11-33, 38-80, and also comprises a light chain that is SEQ ID NO: 34 or a variant thereof selected from SEQ ID NOs: 35-37. In some embodiments, the heavy chain is SEQ ID NO: 160 or a variant thereof selected from SEQ ID NOs: 161-245, and the light chain is SEQ ID NO: 202 or a variant thereof selected from SEQ ID NOs: 203-221.

In some embodiments, the antibody or antigen-binding fragment thereof comprises a heavy chain variable region, wherein the amino acid sequence of the heavy chain variable region is SEQ ID NO: 152 or a variant thereof selected from the group consisting of SEQ ID NOs: 153-158 and 159, and a light chain variable region, wherein the amino acid sequence of the light chain variable region is SEQ ID NO: 184 or a variant thereof selected from the group consisting of SEQ ID NOs: 185-200 and 201.

In one embodiment, the amino acid sequence of the heavy chain variable region is SEQ ID NO: 152. In one embodiment, the amino acid sequence of the light chain variable region is SEQ ID NO: 184. In one embodiment, the amino acid sequence of the heavy chain variable region is SEQ ID NO: 152, and wherein the amino acid sequence of the light chain variable region is SEQ ID NO: 184. In one embodiment, the antibody belongs to $IgG_1(\lambda)$ class (subclass).

In some embodiments, the antibody or antigen-binding fragment thereof comprises a heavy chain variable region, wherein the amino acid sequence of the heavy chain variable region is SEQ ID NO: 348 or a variant thereof selected from the group consisting of SEQ ID NOs: 349-362 and 363, and a light chain variable region, wherein the amino acid sequence of the light chain variable region is SEQ ID NO: 364 or SEQ ID NO: 365.

In one embodiment, the amino acid sequence of the heavy chain variable region is SEQ ID NO: 348. In one embodiment, the amino acid sequence of the light chain variable region is SEQ ID NO: 364. In one embodiment, the amino acid sequence of the light chain variable region is SEQ ID NO: 365. In one embodiment, the antibody belongs to $IgG_1$ (λ) class (subclass).

In one embodiment the anti-hGM-CSF monoclonal antibody or its antigen binding portion capable of binding to hGM-CSF (hGM-CSF) and neutralizing the bioactivity of hGM-CSF as disclosed herein is characterized in that it has a complementarity-determining region (CDR) represented by one or more amino acid sequences selected from the group consisting of SEQ ID NOs: 4 to 9 and SEQ ID NOs: 330 to 335. In some embodiments, one or more amino acids can be substituted, deleted, inserted, or added in the CDR. The anti-hGM-CSF monoclonal antibody or its antigen binding portion as described herein may be characterized in that the anti-hGM-CSF monoclonal antibody or its antigen binding portion inhibits proliferation of TF-1 cells by about 50% at the concentration of about 14 pM, when the TF-1 cells are induced to proliferate by hGM-CSF. In some embodiments, the anti-hGM-CSF monoclonal antibody or its antigen binding portion inhibits proliferation of peripheral blood dendritic cells.

In one embodiment the anti-hGM-CSF monoclonal antibody or its antigen binding portion as described herein has a high affinity for hGM-CSF with $K_D$ value of $4\times10^{-10}$ M or lower.

In some embodiments, the anti-hGM-CSF monoclonal antibody or its antigen binding portion described herein belongs to $IgG_1$(λ) class (subclass). In some embodiments, the anti-hGM-CSF monoclonal antibody of the present invention is a human monoclonal antibody.

The invention further includes nucleic acids and vectors comprising same. In one embodiment, the invention is an isolated nucleic acid encoding an anti-hGM-CSF monoclonal antibody or antigen-binding fragment thereof disclosed herein. In one embodiment the nucleic acid is DNA. In one embodiment the invention is a vector comprising a DNA encoding an anti-hGM-CSF monoclonal antibody or antigen-binding fragment thereof disclosed herein.

The invention further provides a host cell comprising an expression vector that comprises a DNA vector of the invention.

The invention also contemplates a kit comprising: (a) the antibody or antigen-binding fragment thereof of the invention; and (b) one or more containers containing the antibody or antigen-binding fragment thereof.

The invention in one embodiment is an anti-hGM-CSF monoclonal antibody or antigen binding-fragment thereof according to the invention, for use in medicine.

The invention provides compositions comprising an anti-hGM-CSF antibody or fragment thereof that binds to and neutralizes hGM-CSF. Such a composition may be a pharmaceutical composition (e.g., a medicament) that comprises an anti-hGM-CSF antibody and/or fragments thereof (or combination thereof) and a pharmaceutically acceptable carrier. The antibody or antigen-binding fragment thereof of any of the embodiments above is included.

In further embodiments, a composition comprises more than one kind of anti-GM-CSF antibodies, fragments, or combination thereof, each as provided herein. For example, the composition may further comprise a second isolated antibody or antigen-binding fragment thereof that binds hGM-CSF, such that the composition comprises a more than one kind/type (plurality) of antibodies, antigen-binding fragments thereof or combination thereof, each of which binds GM-CSF. In some embodiments, at least one of the plurality of antibodies, antigen-binding fragments thereof or combination thereof that bind hGM-CSF is a polypeptide selected from the group consisting of: SEQ ID NOs: 10-80, 152-245, 320-323, and 348-365.

The invention is also directed to medicinal composition suitable for use in treating a disease caused by hGM-CSF comprising: the anti-hGM-CSF monoclonal antibody or the antigen binding portion according to any one of the embodiments herein, and a pharmaceutically acceptable carrier. Examples of the disease caused by an excessive production of hGM-CSF include: (a) allergic diseases such as asthma, atopy, and pollinosis (allergic rhinitis; hay fever); (b) graft rejection, graft-versus-host disease (GVHD); and (c) autoimmune diseases such as rheumatoid arthritis.

Such compositions or a veterinary drug composition may comprise plural kinds of the anti-hGM-CSF monoclonal antibodies or their antigen binding portions specific for a same particular antigen, and a pharmaceutically acceptable carrier.

In some embodiments, the medicinal composition or the veterinary drug composition which is characterized in that the plural kinds of anti-hGM-CSF monoclonal antibodies or their antigen binding portions comprise two or more types of antibodies or their antigen binding portions, may be selected from the following (a) and (b):

(a) an anti-hGM-CSF monoclonal antibody or its antigen binding portion which has a CDR represented by an amino acid sequence of SEQ ID NOs: 4 to 9, SEQ ID NOs: 330 to 335, SEQ ID NOs: 336 to 341, or SEQ ID NOs: 342 to 347, and which is specific for the hGM-CSF, (b) an anti-hGM-CSF monoclonal antibody or its antigen binding portion of (a) which has an amino acid sequence in which one or more amino acids are substituted, deleted, inserted, or appended, and which is specific for hGM-CSF.

Such medicinal composition or the veterinary drug composition may inhibit the proliferation of TF-1 cells by 80% or more at a concentration of about 55 pM each, when the TF-1 cells are induced to proliferate by hGM-CSF.

The aspect of the invention also contemplates a kit comprising any one of the composition as embraced herein, and one or more containers. In some embodiments, the kit further comprises an instruction. In some embodiments, the kit further comprises a label, an instruction, or both a label and an instruction.

Also provided is the use of the antibody or antigen-binding fragment thereof described herein, or the composition comprising such an antibody or fragment. Any anti-hGM-CSF antibody or antigen-binding fragment thereof or composition as described herein may be used for the manufacture or preparation of a medicament for the treatment of a disease or disorder associated with over-expression of hGM-CSF in a subject, wherein the antibody or antigen-binding fragment thereof binds hGM-CSF and is capable of neutralizing hGM-CSF activity. In some embodiments, the disease or disorder is selected from the group consisting of: chronic obstructive pulmonary disease (COPD), asthma, cystic fibrosis, interstitial lung disease, rhinitis, arthritis and related arthropathies, psoriasis, myeloid leukemia, multiple sclerosis.

For the use as described, the antibody or antigen-binding fragment is administered to the subject at a dose not exceeding a maximum tolerated dose, wherein the maximum tolerated dose is about 500 mg per dose.

An aspect of the invention includes the use of the antibody or antigen-binding fragment thereof or the composition as described in any of the embodiments above, for the treatment of a disease or disorder associated with over-expression of hGM-CSF in a subject, wherein the antibody or antigen-binding fragment thereof binds hGM-CSF and is capable of neutralizing hGM-CSF activity. For example, the disease or disorder may be chronic obstructive pulmonary disease (COPD), asthma, cystic fibrosis, interstitial lung disease, rhinitis, arthritis and related arthropathies, psoriasis, myeloid leukemia or multiple sclerosis. Such use includes administering the antibody or antigen-binding fragment thereof or the composition comprising the same as described in the invention to the subject at a dose not exceeding a maximum tolerated dose, wherein the maximum tolerated dose is about 500 mg per dose.

The invention also provides methods for treating a subject having a disease or disorder that is associated with aberrant expression of hGM-CSF using an anti-hGM-CSF antibody or fragment thereof. The method comprises administering to a subject diagnosed with or at risk of developing a disease or disorder associated with aberrant expression (e.g., over-expression) of hGM-CSF, a composition comprising an anti-hGM-CSF antibody or antigen-binding fragment thereof that neutralizes hGM-CSF activity in vivo in an amount effective to obtain at least one therapeutic effect in the subject.

The invention also includes a method for enhancing anti-hGM-CSF antibody-mediated hGM-CSF-neutralizing activity, characterized in that the plural kinds of anti-hGM-CSF monoclonal antibodies or their antigen-binding portions specific for a same particular antigen are administered simultaneously. In some embodiments, two or more types of antibodies or their antigen binding portions are selected from the following (a) and (b):

(a) a anti-hGM-CSF monoclonal antibody or its antigen binding portion which has a CDR represented by an amino acid sequence of SEQ ID NOs: 4 to 9, SEQ ID NOs: 330 to 335, SEQ ID NOs: 336 to 341, or SEQ ID NOs: 342 to 347, and which is specific for the hGM-CSF; and (b) a anti-hGM-CSF monoclonal antibody or its antigen binding portion of (a) which has an amino acid sequence in which one or more amino acids are substituted, deleted, inserted, or appended, and which is specific for hGM-CSF.

The aspect encompasses methods for enhancing activity characterized in that the two or more types of antibodies or their antigen binding portions inhibit the proliferation of TF-1 cells by 80% or more at a concentration of about 55 pM each, when the TF-1 cells are induced to proliferate by hGM-CSF.

The invention also provides an epitope of hGM-CSF that is recognized by the antibodies and antigen-binding fragments thereof described herein. The epitope of hGM-CSF in polypeptides is set forth in SEQ ID NOs: 2 and 3, wherein the epitope is recognized by the antibody or antigen-binding fragment thereof according to the present disclosure, and wherein the polypeptide sequences represent a discontinuous segment of hGM-CSF (based on SEQ ID NO: 1). The epitope is a discontinuous segment of human GM-CSF, wherein the epitope comprises all or a portion of amino acid residues 77-80 of human GM-CSF (SEQ ID NO: 1) and amino acid residues 95-104 of human GM-CSF (SEQ ID NO: 1), and is recognized by an anti-hGM-CSF monoclonal antibody or antigen-binding fragment thereof comprising 6 different CDRs as set forth in SEQ ID NOs: 4-9 or SEQ ID NOs: 330-335.

The invention also provides for the use of an epitope of the invention. The invention also includes methods for screening and/or identifying a molecule that specifically binds the epitope described herein recognized by the antibodies and antigen-binding fragments thereof provided herein. Some embodiments relate to methods for identifying a molecule that binds the epitope as described herein, comprising: (i) screening a biological sample or a peptide library using a probe that comprises the epitope; (ii) isolating a molecule that specifically binds the probe; and (iii) identifying the molecule. The molecule that binds the epitope may, for example, an anti-hGM-CSF monoclonal antibody or antigen-binding fragment thereof. Some embodiments contemplate the probe further comprising a detectable marker. In some embodiments, the method incorporates the probe that is immobilized.

Also provided are methods or processes for producing anti-hGM-CSF antibodies and antigen-binding fragments thereof. The invention includes methods for producing an anti-hGM-CSF monoclonal antibody or antigen-binding fragment thereof that binds hGM-CSF, wherein the antibody or antigen-binding fragment thereof comprises at least a consensus $V_H$-CDR1-containing sequence, a consensus $V_H$-CDR2-containing sequence, a consensus $V_H$-CDR3-containing sequence, a consensus $V_L$-CDR1-containing sequence, a consensus $V_L$-CDR2-containing sequence, and a consensus $V_L$-CDR3-containing sequence, in a host cell. The method includes the steps of:

(i) obtaining the host cell comprising at least one DNA sequence encoding at least the consensus $V_H$-CDR1-containing sequence, the consensus $V_H$-CDR2-containing sequence, the consensus $V_H$-CDR3-containing sequence, the consensus $V_L$-CDR1-containing sequence, the consensus $V_L$-CDR2-containing sequence, and the consensus $V_L$-CDR3-containing sequence, wherein:

(a) the consensus $V_H$-CDR1-containing sequence is $FTFSX_1X_2MH$ (SEQ ID NO: 314), wherein $X_1$ is Y or H, and $X_2$ is G or A, (b) the consensus $V_H$-CDR2-containing sequence is $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, (c) the consensus $V_H$-CDR3-containing sequence is $EX_nX_9GX_{10}X_nX_nDX_n$ (SEQ ID NO: 316), wherein each $X_n$ independently is any naturally occurring amino acid, $X_9$ M or V, and $X_{10}$ is A or G, (d) the consensus $V_L$-CDR1-containing sequence is $X_nGNX_nX_nNIGSX_{11}AVG$ (SEQ ID NO: 317), wherein each $X_n$ independently is any naturally occurring amino acid, and $X_{11}$ is H or Y, (e) the consensus $V_L$-CDR2-containing sequence is $GX_{12}SPX_{13}SG$ (SEQ ID NO: 318), wherein $X_{12}$ is R or K, and $X_{13}$ is A or P, and (f) the consensus $V_L$-CDR3-containing sequence is $STWDSX_{14}LSAVX_{15}$ (SEQ ID NO: 319), wherein $X_{14}$ is R or S, and $X_{15}$ is V or L;

(ii) expressing the DNA in the host cell; and (iii) culturing the host cell under conditions suitable for expression of DNA and production of the antibody or antigen binding fragment thereof.

In some embodiments, at least one DNA encodes a heavy chain or a portion thereof and a light chain or a portion thereof, wherein the heavy chain or portion thereof is selected from the group consisting of: SEQ ID NOs: 10-33, 38-80, 152-183, 222-245, 348-362, and 363, and wherein the light chain or portion thereof has a sequence selected from the group consisting of SEQ ID NOs: 34-37, 184-221, 364, and 365.

The process above may further comprise isolating the antibody or antigen-binding fragment thereof.

The process above may further comprise preparing a composition comprising said antibody or antigen-binding fragment thereof and a pharmaceutically acceptable carrier.

Also provided are vectors comprising DNA encoding at least a portion of the antibodies or antigen-binding fragments thereof described herein. Host cells expressing such a vector are also included.

In some embodiments, a vector comprises DNA encoding a $V_H$-CDR1, a $V_H$-CDR2, and a $V_H$-CDR3, wherein:

$V_H$-CDR1 is
(SEQ ID NO: 4)
SYGMH
or
(SEQ ID NO: 333)
SHAMH, $V_H$-CDR2 is
(SEQ ID NO: 5)
LTYHHGNRKFYADSVRG
or
(SEQ ID NO: 334)
VIWHDGSKKYYADSVKG,
and $V_H$-CDR3 is
(SEQ ID NO: 6)
ESMGAINDN
or
(SEQ ID NO: 335)
EWVGGTCDS.

In some embodiments, a vector comprises DNA encoding a $V_L$-CDR1, a $V_L$-CDR2, and a $V_L$-CDR3, wherein $V_L$-CDR1 is
(SEQ ID NO: 7)
IGNNNNIGSHAVG
or
(SEQ ID NO: 330)
SGNSSNIGSYAVG, $V_L$-CDR2 is
(SEQ ID NO: 8)
GRSPPSG
or
(SEQ ID NO: 331)
GKSPASG,
and $V_L$-CDR3 is
(SEQ ID NO: 9)
STWDSSLSAVV
or
(SEQ ID NO: 332)
STWDSRLSAVL.

In some embodiments of the invention, the isolated DNA encodes an anti-hGM-CSF monoclonal antibody or its antigen binding portion capable of binding to hGM-CSF and neutralizing the bioactivity of hGM-CSF, characterized in that the isolated DNA encodes an amino acid sequence comprising at least one selected from the group consisting of SEQ ID NOs: 4 to 9. In some embodiments, the isolated DNA encodes an anti-hGM-CSF monoclonal antibody or its antigen binding portion capable of binding to hGM-CSF and neutralizing the bioactivity of hGM-CSF, characterized in that the isolated DNA encodes an amino acid sequence comprising at least one selected from the group consisting of SEQ ID NOs: 330 to 335. The isolated DNA may be capable of hybridizing under stringent conditions with the DNA described above. Vectors incorporating any such DNA, as well as host cells that express the recombinant expression vector(s) are included in the aspect of the invention.

DETAILED DESCRIPTION OF THE INVENTION

Figure 1:
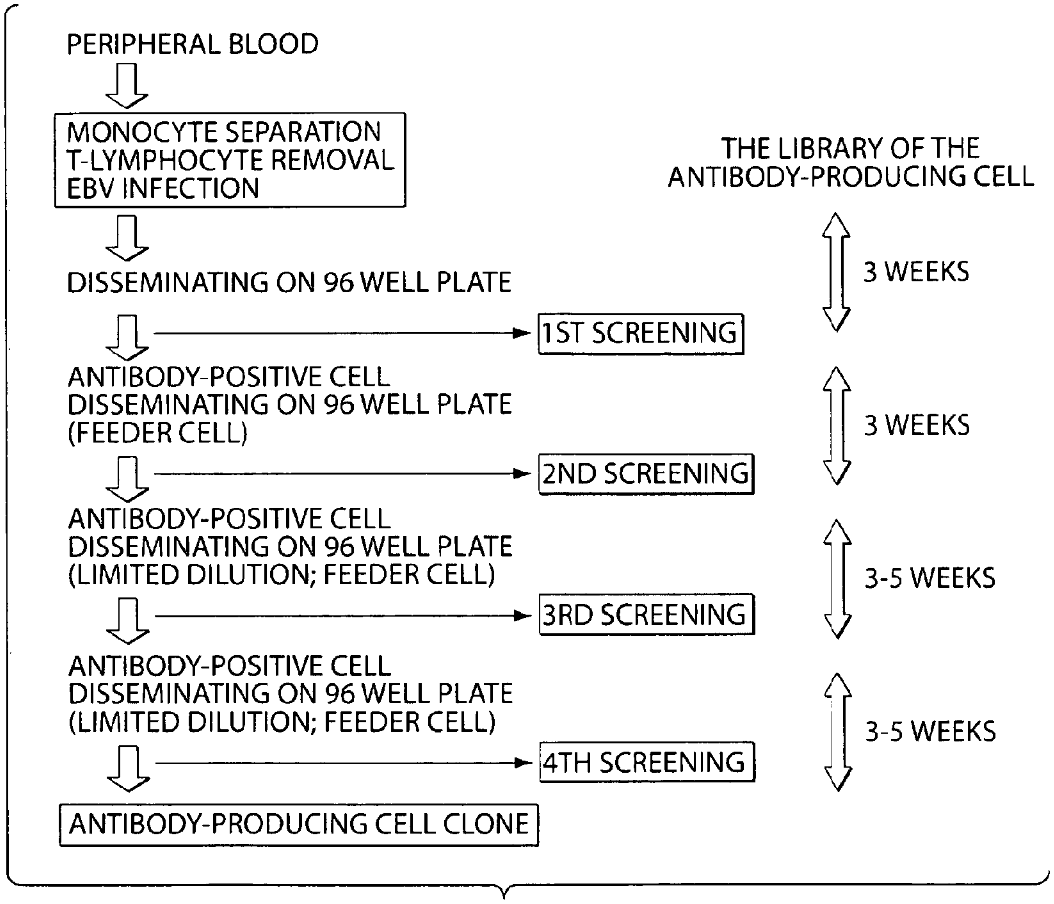
FIG. 1 shows a flow chart of isolation of antibody-producing cell clones.

As described herein, anti-hGM-CSF monoclonal antibody was obtained from an antibody-producing cell derived from the blood of an idiopathic alveolar proteinosis patient. In one embodiment the anti-hGM-CSF monoclonal antibody or its antigen-binding portion in the present invention is obtained from an antibody-producing cell derived from the blood of the idiopathic alveolar proteinosis patient. Accordingly, the anti-hGM-CSF monoclonal antibody or antigen-binding fragment thereof in one embodiment of the present invention is a completely human monoclonal antibody. Therefore, it minimizes the risk of triggering immunogenicity, when the antibody preparation is administered to a human body.

The problem that this invention is going to solve is as follows: This invention focuses on providing GM-CSF-binding monoclonal antibodies and GM-CSF-binding fragments thereof that exhibit improved neutralizing capacity or activity against hGM-CSF and compositions including at least one kind or type of such monoclonal antibodies or fragments thereof, as well as methods of treating conditions or diseases associated with over-expression of hGM-CSF (hGM-CSF levels higher in an individual suffering from a condition, disease or disorder than in an individual who does not suffer from the condition, disease or disorder).

Anti-hGM-CSF monoclonal antibody or antigen-binding fragment thereof described in the present disclosure specifically binds to hGM-CSF, aberrant expression of which can cause various diseases, and reduces or eliminates (neutralizes) its bioactivity. The anti-hGM-CSF monoclonal antibodies exhibit neutralizing activity (to hGM-CSF) which is higher than that of the previously existing anti-hGM-CSF monoclonal antibodies. In particular, anti-hGM-CSF monoclonal antibodies of the present invention which are human monoclonal antibodies do not have immunogenicity and do not induce immunoreaction.

By "binds specifically" is meant high avidity and/or high affinity binding of an antibody to a specific polypeptide e.g., epitope of a protein such as a human GM-CSF protein. Antibody binding to the epitope on this specific polypeptide is preferably stronger than binding of the same antibody to any other epitope, particularly those which may be present in molecules in association with, or in the same sample, as the specific polypeptide of interest e.g., binds more strongly to epitope fragments of a protein such as GM-CSF so that by adjusting binding conditions the antibody binds almost exclusively to an epitope site or fragments of a desired protein such as an epitope fragment exposed by treatment of GM-CSF and not exposed on related factors of the same subfamily. An isolated antibody of the invention is preferably immunoreactive with and immunospecific for a specific species. For example, the antibodies of the invention recognize human GM-CSF, may recognize rhesus GM-CSF and/or marmoset GM-CSF; but generally not that of a murine counterpart. It should be appreciated that the antibodies and antigen-binding fragments thereof as disclosed in this aspect of the invention recognize the epitope of the antigen in a native conformation, or substantially close to its native conformation such that the discontinuous segment of the antigen that are brought together to close proximity within the context of the whole antigen (e.g., hGM-CSF) as observed in structural studies, thereby cooperatively forming an epitope (e.g., "pockets" on the surface of the antigen) that is recognized by the antibodies of the invention. As such, the antibodies or antigen-binding fragments thereof as described in this aspect of the invention do not cross-react with protein that is not GM-CSF that contains both of the polypeptide sequences that form an epitope as described above. It should be appreciated that in the context of antibody-antigen binding, the binding is deemed "specific" by virtue of the nature of the interaction. As such, "an antibody that binds GM-CSF" shall be construed to bind to the antigen (i.e., GM-CSF) with specificity.

As used herein, a term "antibody" indicates an immunoglobulin molecule in which 4 polypeptide chains, 2 heavy chains and 2 light chains are interactively connected by a disulfide bond. Monoclonal antibodies can be generated by monoclonal or recombinant technology. The art is familiar with the technology. The terms "antigen binding portion" and "antigen binding fragment" are used interchangeably herein and describe any shortened variant of the antibody which preferably exhibits the specific antigen binding activity to an antigen (e.g., hGM-CSF). In particular, a fragment of the invention is a fragment that binds hGM-CSF at the same epitope as the respective monoclonal antibody. A fragment can be, for example, an Fab fragment or any other fragment exhibiting the characteristics described above. In addition, the antibody fragments further include single-chain antibody (scFV) in which antibody variable region and complementarity determining region (CDR) are incorporated, bispecific antibody, and multi-specific antibody.

As used herein "bioactivity" is synonymous to biological activity. Thus, "bioactivity of hGM-CSF" is the biological function of hGM-CSF as determined or measured in vivo or in a cell-based assay, such as those described herein. More specifically, the bioactivity of hGM-CSF may be measured in a cell proliferation assay. Appropriate cell lines that are known to respond to GM-CSF are employed. Typically, for a human cell system, the human erythroleukemia cell line, TF-1, is used for carrying out a proliferation assay. TF-1 is a cell line established from a patient with erythroleukemia. The assay is based on the inhibition of GM-CSF stimulated cell proliferation of TF-1 cells and is well established in the art. Other cell lines may also be suitable. One of ordinary skill in the art will be able to adapt appropriate assay systems or conditions.

The TF-1 proliferation assays are carried out in the presence of varying concentrations of wild-type recombinant human GM-CSF (referred to as rhGM-CSF). Based on these data, dose-dependency curves may be obtained. The concentration of the GM-CSF required to elicit 80% of the maximum biological response for proliferation in TF-1 cells is defined herein as $ED_{80}$ or ED80. Thus, ED80 represents "Effective Dose at 80%" of the maximal response. Similarly, the concentration of the GM-CSF required to give a half maximum response in a biological assay is expressed as $ED_{50}$ or ED50. Typically, the ED50 value of GM-CSF is said to be 0.02-1 ng/ml as measured in a cell proliferation assay using the human GM-CSF-dependent TF-1 cell line.

This or any other similar assay systems can be used to identify or determine the activity of an inhibitor or antagonist for hGM-CSF. For example, the proliferation assay system can be used to measure the neutralizing capacity of an antibody against hGM-CSF. Other examples of assays for measuring a biological GM-CSF function include the IL-8 secretion assay and induction of surface CD11b/Mac1 assay.

The terms "neutralization," "neutralize," "neutralizing," and the like refer to inhibition of a biological activity of a bioactive factor, such as hGM-CSF. Thus, an antibody against hGM-CSF with neutralizing capacity or neutralizing activity means that the antibody is capable of binding to and antagonizing or counteracting a biological activity of hGM-CSF in a biological system, e.g the proliferative effect of hGM-CSF in a biological system, such as in TF-1 cells, thereby substantially inhibiting or eliminating a biological activity of hGM-CSF.

The terms such as "inhibitory effect," "inhibition," "capable of inhibiting," and "inhibition" mean 5 to 100% suppression of bioactivity or bioactivities caused by a target antigen, not limited by its origin. For therapeutic purposes, ideally, the inhibition of the hGM-CSF bioactivity should be between 50% and 100%.

In general, the $IC_{50}$ is a measure of the effectiveness of a compound in inhibiting biological or biochemical function. This quantitative measure indicates how much of a particular drug or other agent (inhibitor) is needed to inhibit a given biological process (or component of a process, i.e. an enzyme, cell, cell receptor or microorganism) by half. In other words, it is the half maximal (50%) inhibitory concentration (IC) of a substance (50% IC, or $IC_{50}$). It is commonly used as a measure of antagonist drug potency in pharmacological research. According to the guidelines adopted by the United States Food and Drug Administration, $IC_{50}$ represents the concentration of a drug that is required for 50% inhibition in vitro.

Accordingly, the $IC_{50}$ of a neutralizing antibody against hGM-CSF can be determined by constructing a dose-response curve and examining the effect of different concentrations of the neutralizing antibody on reversing the proliferative activity of hGM-CSF. $IC_{50}$ values can be calculated for a given antagonist by determining the concentration needed to inhibit half of the maximum biological response of the agonist.

According to various embodiments, the anti-hGM-CSF monoclonal antibody or antigen-binding fragment thereof has an $IC_{50}$ value of less than 20 pM, less than 25 pM, less than 30 pM, less than 40 pM, less than 50 pM, less than 60 pM, less than 70 pM, less than 80 pM, less than 90 pM or less than 100 pM, in each instance as determined in a TF-1 proliferation assay at ED80. In specific embodiments, the antibody or antigen-binding fragment thereof has an $IC_{50}$ value of less than 20 pM, less than 25 pM, less than 30 pM or less than 40 pM, as determined in a TF-1 proliferation assay at ED80.

The anti-hGM-CSF monoclonal antibodies in the present disclosure include immunoglobulin molecules comprising 2 heavy chains and 2 light chains. Each of the heavy chains includes a heavy chain variable region (suitably abbreviated to "HCVR" or "$V_H$") and a heavy chain constant region (the heavy chain constant region has 3 domains, which are abbreviated to "CH1," "CH2," and "CH3"). Each of the light chains includes a light chain variable region (suitably abbreviated to "LCVR" or "$V_L$") and a light chain constant region (the light chain constant region has one domain abbreviated to "$C_L$"). The HCVR and LCVR are particularly important for the binding specificity of the antibody.

The amino acid sequence of the variable region is responsible for most of the interaction between the antibody and antigen. Therefore, when an expression vector is constructed which contains a variable region sequence derived from a natural antibody in a framework sequence derived from a different antibody with a different property, the resulting vector can express recombinant antibody which mimics a property of the natural antibody. Therefore, it is not necessary to obtain a complete sequence of a particular antibody when generating an intact recombinant antibody having a similar binding property as the original antibody. A partial sequence of a heavy chain and a light chain which covers the variable region can sometimes be sufficient to achieve that purpose.

The antibody interacts with the target antigen mainly via the amino acid residues of the LCVR and HCVR. Therefore, the amino acid sequences in the variable regions are more diverse among antibodies than those outside the variable region. The HCVR and LCVR are further subdivided into the relatively stable "framework region (FR)" and the hyper-variable "complementarity determining region (CDR)." The HCVR and LCVR each consists of 3 CDRs and 4 FRs, respectively. Their order is FR1, CDR1, FR2, CDR2, FR3, CDR3, and FR4, from the amino-terminal to the carboxy-terminal.

The art is familiar with the methods of determining or predicting the amino acid residues that correspond to each of the antibody structural domains, including the hyper-variable regions, e.g., CDRs. Some of the commonly used methods include Chothia, AbM and Kabat.

Generally, antibody binds to antigen with an affinity of at least about $1\times10^{-7}$ M, and binds to a certain antigen with high affinity at least twice in comparison with nonspecific antigens (e.g., BSA, casein).

A term "high affinity" to a certain IgG antibody means that an antibody has a binding affinity at least about $1\times10^{-7}$ M, preferably at least about $1\times10^{-8}$ M, more preferably at least $1\times10^{-9}$ M, and much more preferably at least $1\times10^{-19}$ M.

Definition of "high affinity" is different among antibody isotypes. For example, the IgM isotype is defined to have a "high affinity," when it has a binding affinity at least $1\times10^{-7}$ M.

Antibodies of the Invention

As described herein, the invention concerns anti-human GM-CSF (anti-hGM-CSF) monoclonal antibodies and fragments thereof with higher neutralizing capacity for hGM-CSF than existing monoclonal antibodies (than presently-available monoclonal antibodies) against hGM-CSF. One type or kind of the anti-hGM-CSF monoclonal antibodies or fragments thereof described herein can be used or administered.

Alternatively, more than one type or kind of the anti-hGM-CSF monoclonal antibodies can be used or administered together. The inventors found that when more than one kind or type of the anti-GM-CSF monoclonal antibodies is used together, they provide higher neutralizing activity (e.g., greater cell growth-inhibiting activity). Further, one or more type or kind of the anti-hGM-CSF monoclonal antibodies or fragments thereof can be used or administered in combination with one or more other therapeutic agent that is not an antibody, such as a small molecule, RNAi or peptide.

In one aspect, isolated monoclonal antibodies or antigen-binding fragments thereof that recognize and bind specifically to hGM-CSF are provided. Described herein are isolated anti-hGM-CSF monoclonal antibodies and antigen-binding fragments thereof that bind to hGM-CSF (anti-hGM-CSF monoclonal antibodies that bind to hGM-CSF and antigen-binding fragments thereof that bind to hGM-CSF) and exhibit neutralizing capacity or neutralizing activity against the bioactivity of hGM-CSF. In one embodiment are isolated anti-hGM-CSF monoclonal antibodies and antigen-binding fragments thereof that bind to hGM-CSF and exhibit neutralizing capacity or activity against hGM-CSF, wherein the monoclonal antibody and the antigen-binding fragment thereof recognize the following: ELYK (SEQ ID NO: 2) and TMMASHYKQH (SEQ ID NO: 3) in hGM-CSF (SEQ ID NO: 1). Isolated anti-hGM-CSF monoclonal antibodies and antigen-binding fragments thereof that bind to hGM-CSF, wherein the monoclonal antibody and the antigen-binding fragment thereof recognize the following: ELYK (SEQ ID NO: 2) and TMMASHYKQH (SEQ ID NO: 3) in hGM-CSF, exhibit neutralizing capacity or activity against hGM-CSF activity and are useful for treating and preventing disease, conditions and disorders associated with over-expression of hGM-CSF. A specific embodiment is an isolated anti-hGM-CSF monoclonal antibody or antigen-binding fragment thereof that binds to hGM-CSF, wherein the antibody or antigen-binding fragment recognizes the following discontinuous epitope of hGM-CSF, as defined (SEQ ID NO: 1), corresponding to amino acids: ELYK (SEQ ID NO: 2) at position 77-80 in hGM-CSF and TMMASHYKQH (SEQ ID NO: 3) at position 95-104 in hGM-CSF. The isolated anti-hGM-CSF monoclonal antibodies and antigen-binding fragments thereof described herein specifically bind to hGM-CSF. They do not cross-react with a protein which is a protein other than GM-CSF.

More specifically, described herein are monoclonal antibodies that specifically bind hGM-CSF and have the capacity to neutralize the biological activity of hGM-CSF. Four such antibodies described herein are designated as EV1018, EV1019, EV1003 and EV1007, as summarized in Tables 1 and 2 in the Examples. Thus, EV1018, EV1019, EV1003 and EV1007 bind hGM-CSF and are able to neutralize the growth-promoting effects of hGM-CSF. As shown in more detail, the EV1018 and EV1019 antibodies recognize the same or substantially overlapping epitope on the hGM-CSF protein.

Further embraced by the invention is an anti-hGM-CSF monoclonal antibody or its antigen-binding portion, characterized in that the anti-hGM-CSF monoclonal antibody or its antigen-binding portion has an amino acid sequence in which one or more amino acids is substituted, deleted, inserted or added in a complementarity-determining region (CDR).

In further aspect, provided is an isolated deoxyribonucleic acid (DNA) encoding an anti-hGM-CSF monoclonal antibody or its antigen-binding portion capable of binding to hGM-CSF and neutralizing bioactivity of hGM-CSF, characterized in that the isolated DNA encodes an amino acid sequence comprising at least one selected from the group consisting of SEQ ID NOs: 4-9.

One embodiment of the present invention relates to an anti-hGM-CSF monoclonal antibody or an antigen binding portion capable of binding to hGM-CSF (hGM-CSF) and neutralizing bioactivity of the hGM-CSF (hGM-CSF), characterized in that the anti-hGM-CSF monoclonal antibody or the antigen binding portion has a complementarity-determining region (CDR) represented by at least one amino acid sequence selected from the group consisting of SEQ ID NOs: 4 to 9.

Another embodiment of the present invention relates to an anti-hGM-CSF monoclonal antibody or an antigen binding portion capable of binding to hGM-CSF and neutralizing bioactivity of the hGM-CSF, characterized in that the anti-hGM-CSF monoclonal antibody or the antigen binding portion has a complementarity-determining region (CDR) represented by at least one amino acid sequence selected from the group consisting of SEQ ID NOs: 330-335.

In the present invention, an anti-hGM-CSF monoclonal antibody which has a complementarity-determining region (CDR) represented by one or more amino acid sequences selected from the group consisting of SEQ ID NOs: 4 to 9, and, an anti-hGM-CSF monoclonal antibody which has a complementarity-determining region (CDR) represented by one or more amino acid sequences selected from the group consisting of SEQ ID NOs: 330-335, are considered as different kinds of anti-hGM-CSF monoclonal antibodies.

A monoclonal antibody or its antigen binding portion in which one or more amino acids are deleted, replaced, inserted or added in the complementarity-determining regions (CDRs) will be included in the present invention as long as it specifically binds to hGM-CSF and neutralizes its bioactivity.

The present invention includes the monoclonal antibody or its antigen binding portion capable of binding to hGM-CSF and neutralizing bioactivity of the hGM-CSF, wherein the anti-hGM-CSF monoclonal antibody or its antigen binding portion has a CDR selected from the group consisting of:

(a) a light chain (L chain) CDR1 having an amino acid sequence of SEQ ID NO: 7,
(b) a light chain (L chain) CDR2 having an amino acid sequence of SEQ ID NO: 8, and
(c) a light chain (L chain) CDR3 having an amino acid sequence of SEQ ID NO: 9.

In the same way, the present invention includes the monoclonal antibody or its antigen binding portion capable of binding to hGM-CSF and neutralizing bioactivity of the hGM-CSF, wherein the anti-hGM-CSF monoclonal antibody or its antigen binding portion has a CDR selected from the group consisting of:

(d) a light chain (L chain) CDR1 having an amino acid sequence of SEQ ID NO: 330,
(e) a light chain (L chain) CDR2 having an amino acid sequence of SEQ ID NO: 331, and
(f) a light chain (L chain) CDR3 having an amino acid sequence of SEQ ID NO: 332.

The following anti-hGM-CSF monoclonal antibody or its antigen binding portion, when it binds specifically to the hGM-CSF and neutralizes its bioactivity, is also incorporated in the present invention: anti-hGM-CSF monoclonal antibody or its antigen binding portion, wherein, the light chain complementarity-determining region (CDR) described above was modified by deletion, replacement, insertion or addition of one or more amino acids.

The present invention includes an anti-hGM-CSF monoclonal antibody or its antigen binding portion capable of binding to hGM-CSF and neutralizing bioactivity of the hGM-CSF, wherein the anti-hGM-CSF monoclonal antibody or its antigen binding portion has a CDR selected from the group consisting of:

(a) a heavy chain (H chain) CDR1 having an amino acid sequence of SEQ ID NO: 4,
(b) a heavy chain (H chain) CDR2 having an amino acid sequence of SEQ ID NO: 5, and
(c) a heavy chain (H chain) CDR3 having an amino acid sequence of SEQ ID NO: 6.

In the same way, the present invention includes the monoclonal antibody or its antigen binding portion capable of binding to hGM-CSF and neutralizing bioactivity of the hGM-CSF, wherein the anti-hGM-CSF monoclonal antibody or its antigen binding portion has a CDR selected from the group consisting of:

(a) a heavy chain (H chain) CDR1 having an amino acid sequence of SEQ ID NO: 333,
(b) a heavy chain (H chain) CDR2 having an amino acid sequence of SEQ ID NO: 334, and
(c) a heavy chain (H chain) CDR3 having an amino acid sequence of SEQ ID NO: 335.

The following anti-hGM-CSF monoclonal antibody or its antigen binding portion, when it binds specifically to the hGM-CSF and neutralizes its bioactivity, is also incorporated in the present invention:

Anti-hGM-CSF monoclonal antibody or its antigen binding portion, wherein the heavy chain complementarity-determining region (CDR) described above was modified by deletion, replacement, insertion or addition of one or more amino acids.

The GM-CSF Epitope

Also the subject herein is an epitope of hGM-CSF, that is a discontinuous segment of human GM-CSF, wherein the epitope comprises amino acid residues 77-80 of human GM-CSF (SEQ ID NO: 1) and amino acid residues 95-104 of human GM-CSF (SEQ ID NO: 1), and is defined by the polypeptide sequences as set forth in SEQ ID NO: 2 and SEQ ID NO: 3, and is recognized by an anti-hGM-CSF monoclonal antibody or antigen-binding fragment thereof comprising 6 different CDRs as set forth in SEQ ID NOs: 4-9 or SEQ ID NOs: 330-335.

As described in more detail in the Examples, the epitope of hGM-CSF recognized by the monoclonal antibodies EV1018 and EV1019 was identified by an epitope mapping study. It was found that both EV1018 and EV1019 recognized the same (or substantially overlapping) site of the hGM-CSF antigen, corresponding to amino acid residues 77-80 and 95-104, as determined according to GenBank Accession No:

NP_000749. Structural studies have indicated that while the two segments are discontinuous in the primary sequence, the two segments of the polypeptide are brought close together when folded, cooperatively forming a conformational epitope. Consistent with the observation that both EV1018 and EV1019 recognize the same or substantially overlapping epitope, analyses of the CDR sequences of EV1018 and EV1019 show substantial similarities. Comparing the peptide sequences of the CDRs of these two antibodies, the following consensus sequences (e.g., formulae) are obtained, representing the overlapping (e.g., common) residues comprising each of the CDRs:

For $V_H$-CDR1: $FTFSX_1X_2MH$ (SEQ ID NO: 314), wherein $X_1$ is Y or H, and $X_2$ is G or A;

For $V_H$-CDR2: $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K;

For $V_H$-CDR3: $EX_nX_9GX_{10}X_nX_nDX_n$ (SEQ ID NO: 316), wherein each $X_n$ independently is any naturally occurring amino acid, $X_9$ is M or V, and $X_{10}$ is A or G;

For $V_L$-CDR1: $X_nGNX_nX_nNIGSX_{11}AVG$ (SEQ ID NO: 317), wherein each $X_n$ independently is any naturally occurring amino acid, and $X_{11}$ is H or Y;

For $V_L$-CDR2: $GX_{12}SPX_{13}SG$ (SEQ ID NO: 318), wherein $X_{12}$ is R or K, and $X_{13}$ is A or P; and For $V_L$-CDR3: $STWDSX_{14}LSAVX_{15}$ (SEQ ID NO: 319), wherein $X_{14}$ is R or S, and $X_{15}$ is V or L.

In each of the consensus formulae, amino acid residues comprising a corresponding CDR are shown in the conventional single-letter format. The identical residues which are shared by both EV1018 and EV1019 are shown. Accordingly, another embodiment herein is an isolated anti-hGM-CSF monoclonal antibody or antigen-binding fragment thereof that binds to hGM-CSF and exhibits neutralizing capacity or activity against hGM-CSF, wherein the antibody or antigen-binding fragment thereof comprises (a) a heavy chain or, in case of an antibody fragment, a part of a heavy chain, comprising (i) a consensus $V_H$-CDR1-containing sequence $FTFSX_1X_2MH$ (SEQ ID NO: 314), wherein $X_1$ is Y or H, and $X_2$ is G or A, (ii) a consensus $V_H$-CDR2-containing sequence $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, and (iii) a consensus $V_H$-CDR3-containing sequence $EX_nX_9GX_{10}X_nX_nDX_n$ (SEQ ID NO: 316), wherein each $X_n$ independently is any naturally occurring amino acid, $X_9$ is M or V, and $X_{10}$ is A or G; and (b) a light chain or, in case of an antibody fragment, a light chain or a part thereof, comprising (i) a consensus $V_L$-CDR1-containing sequence $X_nGNX_nX_nNIGSX_{11}AVG$ (SEQ ID NO: 317), wherein each $X_n$ independently is any naturally occurring amino acid, and $X_{11}$ is H or Y, (ii) a consensus $V_L$-CDR2-containing sequence $GX_{12}SPX_{13}SG$ (SEQ ID NO: 318), wherein $X_{12}$ is R or K, and $X_{13}$ is A or P, and (iii) a consensus $V_L$-CDR3-containing sequence $STWDSX_{14}LSAVX_{15}$ (SEQ ID NO: 319), wherein $X_{14}$ is R or S, and $X_{15}$ is V or L; and wherein the antibody or fragment thereof recognizes ELYK (SEQ ID NO: 2) and TMMASHYKQH (SEQ ID NO: 3) in hGM-CSF. In a specific embodiment, the anti-hGM-CSF monoclonal antibody or antigen-binding fragment thereof binds to a discontinuous epitope in the following: ELYK (SEQ ID NO: 2) and TMMASHYKQH (SEQ ID NO: 3) in hGM-CSF (SEQ ID NO: 1).

Another embodiment described herein is an isolated anti-hGM-CSF monoclonal antibody that binds to hGM-CSF or an antigen-binding fragment thereof that binds to hGM-CSF, wherein the antibody or fragment thereof comprises (a) a heavy chain or, in case of an antibody fragment, a part of a heavy chain, comprising (i) a consensus $V_H$-CDR1-containing sequence $FTFSX_1X_2MH$ (SEQ ID NO: 314), wherein $X_1$ is Y or H, and $X_2$ is G or A, (ii) a consensus $V_H$-CDR2-containing sequence $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, and (iii) a consensus $V_H$-CDR3-containing sequence $EX_nX_9GX_{10}X_nX_nDX_n$ (SEQ ID NO: 316), wherein each $X_n$ independently is any naturally occurring amino acid, $X_9$ is M or V, and $X_{10}$ is A or G; and (b) a light chain or, in case of an antibody fragment, a light chain or a part thereof, comprising (i) a consensus $V_L$-CDR1-containing sequence $X_nGNX_nX_nNIGSX_{11}AVG$ (SEQ ID NO: 317), wherein each $X_n$ independently is any naturally occurring amino acid, and $X_{11}$ is H or Y, (ii) a consensus $V_L$-CDR2-containing sequence $GX_{12}SPX_{13}SG$ (SEQ ID NO: 318), wherein $X_{12}$ is R or K, and $X_{13}$ is A or P, and (iii) a consensus $V_L$-CDR3-containing sequence $STWDSX_{14}LSAVX_{15}$ (SEQ ID NO: 319), wherein $X_{14}$ is R or S, and $X_{15}$ is V or L; and wherein the antibody or fragment thereof binds to hGM-CSF with a $K_D$ of no more than 400 pM, in another embodiment of less than 160 pM, whereby the $K_D$ is determined in accordance with the techniques described in Example 11.

In another embodiment, the anti-hGM-CSF monoclonal antibody or antigen-binding fragment thereof is characterized in that the anti-hGM-CSF monoclonal antibody or its antigen binding anti-hGM-CSF monoclonal antibody or antigen-binding fragment thereof inhibits proliferation of peripheral blood dendritic cells. Accordingly, a further embodiment is an isolated anti-hGM-CSF monoclonal antibody that binds to hGM-CSF or an antigen-binding fragment thereof that binds to hGM-CSF, the anti-hGM-CSF monoclonal antibody or fragment thereof comprising a heavy chain or portion thereof and a light chain or portion thereof. A heavy chain or, in case of an antibody fragment, a part of a heavy chain, may comprise $V_H$-CDR1, $V_H$-CDR2 and $V_H$-CDR3. In some embodiments, a consensus sequence is represented by the formula $FTFSX_1X_2MH$ (SEQ ID NO: 314), wherein $X_1$ is Y or H, and $X_2$ is G or A, which comprises $V_H$-CDR1. Similarly, the formula $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, represents a consensus sequence that comprises $V_H$-CDR2; and the formula $EX_nX_9GX_{10}X_nX_nDX_n$ (SEQ ID NO: 316), wherein each $X_n$ independently is any naturally occurring amino acid, $X_9$ is M or V, and $X_{10}$ is A or G, represents a consensus sequence that comprises $V_H$-CDR3. A light chain or, in case of an antibody fragment, a light chain or a part thereof, may comprise $V_L$-CDR1, $V_L$-CDR2 and $V_L$-CDR3. In such an embodiment, the formula $X_nGNX_nX_nNIGSX_{11}AVG$ (SEQ ID NO: 317), wherein each $X_n$ independently is any naturally occurring amino acid, and $X_{11}$ is H or Y, represents a consensus sequence comprising $V_L$-CDR1; the formula $GX_{12}SPX_{13}SG$ (SEQ ID NO: 318), wherein $X_{12}$ is R or K, and $X_{13}$ is A or P, represents a consensus sequence that comprises $V_L$-CDR2; and the formula $STWDSX_{14}LSAVX_{15}$ (SEQ ID NO: 319), represents a consensus sequence that comprises $V_L$-CDR3.

In any of the embodiments, the antibody or fragment thereof neutralizes hGM-CSF activity. In specific embodiments, the anti-hGM-CSF monoclonal antibody or fragment thereof neutralizes hGM-CSF activity, such that the antibody or fragment has an $IC_{50}$ value in a proliferation inhibition assay of less than 20 pM, less than 30 pM, less than 40 pM, less than 50 pM, less than 60 pM, less than 70 pM, less than 80 pM, less than 90 pM or less than 100 pM, in each instance as determined in a TF-1 proliferation assay performed at ED80 and as described in Example 12. In a specific embodiment, the anti-hGM-CSF monoclonal antibody or antigen-binding fragment thereof as claimed has an $IC_{50}$ value that is less than 40 pM or less than 30 pM, as determined in a said TF-1 proliferation assay at ED80. In a specific embodiment, the anti-hGM-CSF monoclonal antibody or antigen-binding fragment thereof as claimed has an $IC_{50}$ value that is less than 25 pM or less than 20 pM, as determined in a said TF-1 proliferation assay at ED80. In a further embodiment, the invention provides an anti-hGM-CSF monoclonal antibody or antigen-binding fragment thereof, characterized in that the anti-hGM-CSF monoclonal antibody or antigen-binding fragment thereof inhibits proliferation of TF-1 cells by about 50% at a concentration of about 14 pM, when the TF-1 cells are proliferated by the induction of hGM-CSF.

As demonstrated in more detail in the Examples, EV1018 and EV1019 are both effective in neutralizing hGM-CSF bioactivity. Because these antibodies substantially share the same conformational epitope as described above, it is possible to use the epitope to screen for additional molecules that recognize the epitope, such as monoclonal antibodies or fragments thereof. Accordingly, the invention also contemplates screening methods, wherein the epitope of hGM-CSF, that is defined by the polypeptide sequences as set forth in SEQ ID NO: 2 and SEQ ID NO: 3 and is recognized by EV1018, EV1019 or a variant thereof. Such method comprises (i) screening a biological sample or a peptide library using a probe that comprises the epitope; (ii) isolating a molecule that specifically binds the probe; and (iii) identifying the molecule. In one embodiment, the method further includes the step of producing the molecule. In some embodiments, the molecule identified using the method is an anti-hGM-CSF monoclonal antibody or antigen-binding fragment thereof. In some cases, the probe may further comprise a detectable marker, including but are not limited to, a label, dye, affinity tag, etc. According to some embodiments, the probe may be immobilized, for purposes of, for example, screening for binding molecules. Screening methods are generally available and are well known to the skilled artisan.

In any of the embodiments described herein, the antibody or antigen-binding fragment thereof may be any sub-type of immunoglobulins, such as of the IgG class, such as $IgG_1$, $IgG_2$, and $IgG_4$. Accordingly, in any of the embodiments described herein, the heavy chain can be, for example, of the gamma class, such as gamma 1 ($\gamma_1$), gamma 2 ($\gamma_2$), gamma 3 ($\gamma_3$) or gamma 4 ($\gamma_4$). In any of the embodiments described above, the heavy chain can be selected from (the amino acid residues of the heavy chain are selected from) the group consisting of polypeptides as set forth in SEQ ID NOs: 10-33, 38-80 and 152-245, and 348-363. In some embodiments, portion of a heavy chain may be used, including, variable regions of a heavy chain. Non-limiting examples of variable regions of a heavy chain as described in the present disclosure are provided in SEQ ID NOs: 152-159 and 348-363.

In the anti-hGM-CSF monoclonal antibodies and antigen-binding fragments thereof, the light chain can be a lambda light chain, or a part thereof, or a kappa light chain, or a part thereof. In specific embodiments, the lambda light chain contains one or both of the following amino acid substitutions: R100G and A153G. (contains substitution R100Q substitution A153G, or both substitution R100G and substitution A153G). It should be noted that substitutions in the amino acid sequence of antibody chains are described herein by referring to an appropriate reference amino acid sequence, whereby the designation of position 100 and 153 in any light chain or fragment thereof shall according to the invention be determined by comparison of SEQ ID NO: 35 and SEQ ID NO: 34 as those amino acid positions corresponding to the amino acid positions in SEQ ID NO: 35 in which R is replaced by G and A by G, respectively, if compared with the sequence in SEQ ID 34. For example, in the case above, in which the lambda light chain can contain one or both of the amino acid substitutions described, the reference amino acid sequence is EV1018 light chain (EV1018-wt-original; SEQ ID NO: 34). R100G indicates that the R (arginine) at position 100 in the EV1018 light chain is substituted by G (glycine); A153G indicates that the A (alanine) at position 153 in the EV1018 light chain is substituted by G (glycine).

In specific embodiments, the light chain is selected from the group consisting of polypeptides as set forth in (whose amino acid residues are represented by) SEQ ID NOs: 34-37 and 184-221 and 364-365. Examples of variable regions of a light chain as described herein are provided in SEQ ID NOs: 184-201 and 364-365.

A light chain may comprise one or a combination of two or more of these amino acid substitutions, as well as others that do not substantially compromise the ability of an antibody or antigen-binding fragment thereof to bind hGM-CSF and neutralize its activity. In one embodiment the light chain comprises an amino acid substitution at either or both of position 100 and position 153 such that glycosylation is not possible at either or both of these positions.

The heavy chain of the anti-hGM-CSF monoclonal antibody that binds to hGM-CSF or an antigen-binding fragment thereof can comprise one or more amino acid substitutions, such as T97A, T97V, N95D, N95E, N95K, N95Q, N93Q/N95T, K144R, L164A, and L165A. It should be noted that substitutions in the amino acid sequence of antibody chains are described herein by referring to an appropriate reference amino acid sequence and for determination of the positions the same principle shall apply as described above in context with the R100G and A153G substitutions. For example, in the case above, in which the heavy chain can contain one or more amino acid substitutions as described, the reference amino acid sequence is EV1018 heavy chain (EV1018; SEQ ID NO: 10). For example, T97A indicates that the T (threonine) at position 97 in the EV1018 heavy chain is substituted by A (alanine); L164A indicates that the L (leucine) at position 164 in the EV1018 heavy chain is substituted by A (alanine).

A heavy chain may comprise one or a combination of two or more of these amino acid substitutions, as well as others that do not substantially compromise the ability of an antibody or antigen-binding fragment thereof to bind hGM-CSF and neutralize its activity.

Further details regarding embodiments of the present invention are outlined in the following:

In one embodiment, the heavy chain contains one or more, or one or a combination of, amino acid substitutions selected from the group consisting of Q3E, T97A, T97V, N95D, N95E, N95K, N95Q, N93Q/N95T, K144R, L164A, and L165A. In a further embodiment, the heavy chain contains one or more amino acid substitutions selected from the group consisting of Q3E, T97A, T97V, N95D, N95E, N95K, N95Q, N93Q/N95T, K144R, L164A, and L165A, and wherein the light chain contains one or both of the following amino acid substitutions R100G and A153G.

A further embodiment is an anti-hGM-CSF monoclonal antibody that binds to hGM-CSF or an antigen-binding fragment thereof that binds to hGM-CSF, wherein the $V_H$-CDR1 comprises amino acid residues SYGMH (SEQ ID NO: 4) or SHAMH (SEQ ID NO: 333).

A further embodiment is an anti-hGM-CSF monoclonal antibody that binds to hGM-CSF or an antigen-binding fragment thereof that binds to hGM-CSF, wherein the $V_H$-CDR2 comprises amino acid residues LTYHHGNRKFYADSVRG (SEQ ID NO: 5) or VIWHDGSKKYYADSVKG (SEQ ID NO: 334).

A further embodiment is an anti-hGM-CSF monoclonal antibody that binds to hGM-CSF or an antigen-binding fragment thereof that binds to hGM-CSF, wherein the $V_H$-CDR3 comprises amino acid residues ESMGAINDN (SEQ ID NO: 6) or EWVGGTCDS (SEQ ID NO: 335).

Further embodiments of the present invention are as follows:

An anti-hGM-CSF monoclonal antibody that binds to hGM-CSF or an antigen-binding fragment thereof that binds to hGM-CSF, wherein the $V_L$-CDR1 comprises amino acid residues IGNNNNIGSHAVG (SEQ ID NO: 7) or SGNSSNIGSYAVG (SEQ ID NO: 330);

An anti-hGM-CSF monoclonal antibody that binds to hGM-CSF or an antigen-binding fragment thereof that binds to hGM-CSF, wherein the $V_L$-CDR2 comprises amino acid residues GRSPPS (SEQ ID NO: 8) or GKSPAS (SEQ ID NO: 331); and An anti-hGM-CSF monoclonal antibody that binds to hGM-CSF or an antigen-binding fragment thereof that binds to hGM-CSF, wherein the $V_L$-CDR3 comprises amino acid residues STWDSSLSAVV (SEQ. ID NO: 9) or STWDSRLSAVL (SEQ ID NO: 332).

Additional embodiments of the present invention relate to an anti-hGM-CSF monoclonal antibody that binds to hGM-CSF or an antigen-binding fragment thereof that binds to hGM-CSF, further comprising a signal sequence.

The signal sequence can be any of a variety of signal sequences known to those of skill in the art, such as any signal sequence that is useful for allowing or enhancing expression and/or passage of the encoded product out of cells in which it is produced, including, but not limited to a signal sequence selected from the group consisting of SEQ ID NOs: 324, 325 and 326.

In all embodiments, the anti-hGM-CSF monoclonal antibody can be a human antibody, a humanized antibody, or a single-chain antibody.

Binding Activity of the Antibodies

In one aspect and unexpectedly, as shown in the Examples of this disclosure, the measured binding affinity of antibodies to the antigen (hGM-CSF) is not linearly correlated with its neutralizing capacity (e.g., ability to neutralize hGM-CSF bioactivity). This observation is contrary to the general notion that higher affinity corresponds to higher neutralizing capacity. For example, it was found that an antibody disclosed herein, i.e. an antibody using the CDRs described herein for recognizing the epitope described herein, e.g. EV1018, shows a more than 100 fold higher inhibition in the TF-1 assay than a prior art antibody as shown in Table 7, while the binding affinity was less than 50% of that of the prior art antibody. This is in contrast to the teaching of WO2006/122797, which shows that the higher the affinity of an antibody, the higher the activity in the TF-1 assay.

Neutralizing Activity of the Antibodies

Human peripheral blood mononuclear cells and the tumor cell line TF-1 may proliferate in response to hGM-CSF stimulation. The neutralizing activity of the anti-hGM-CSF monoclonal antibody or antigen-binding fragment thereof is confirmed by measuring the inhibitory effect on their proliferation. It is known that human peripheral blood monocytes and TF-1 cells may proliferate, when cultivated in the presence of hGM-CSF. Such proliferation can be inhibited by adding the anti-hGM-CSF monoclonal antibody or antigen-binding fragment thereof of the present invention in the culture system, or by first reacting hGM-CSF with anti-hGM-CSF monoclonal antibody or antigen-binding fragment thereof of the present invention and then adding it to the culture system. For example, the anti-hGM-CSF monoclonal antibody or antigen-binding fragment thereof of the present invention may have, as neutralizing activity against TF-1 cells in which cell proliferation is induced by hGM-CSF, a cytostatic rate of 40-60% (approximately 50%) compared to the negative subject (31 pg/ml of hIgG) at a concentration of approximately 2 ng/ml (approximately 14 pM).

The anti-hGM-CSF monoclonal antibody or antigen-binding fragment thereof in the present invention has neutralizing capacity to the hGM-CSF, which is higher than the existing anti-hGM-CSF monoclonal antibody. Therefore, it is expected to be applicable as therapeutic agents used in smaller amounts or doses for the treatment of various diseases caused by hGM-CSF, such as allergic dermatitis, autoimmune diseases, chronic obstructive pulmonary disease (COPD), asthma, cystic fibrosis, interstitial lung disease, rhinitis, arthritis and related arthropathies like rheumatoid arthritis, psoriasis, myeloid leukemia, and multiple sclerosis.

Therapeutic Compositions, Kits and Therapeutic Use

The anti-hGM-CSF antibodies and antigen-binding fragments disclosed herein are effective in neutralizing the biological activity of hGM-CSF, and therefore useful for treating a medical condition (e.g., disease or disorder) that is associated with (e.g., caused by) aberrant expression of hGM-CSF in a subject. Accordingly, such therapeutic use shall be embraced by the present invention.

The invention in certain embodiments provides methods of treating diseases or conditions as described herein, comprising administering to a patient an antibody or antigen-binding fragment thereof described herein or a composition described herein.

As used herein, the term "disease or disorder associated with over-expression of hGM-CSF" shall generally refer to "a disease caused by hGM-CSF." The term shall include any diseases that cause and worsen the pathology, when a subject has GM-CSF. The term also includes other diseases that cause and worsen the pathophysiology. It is expected that inhibiting the biological activity of GM-CSF may palliate the disease symptoms associated with elevated GM-CSF, and/or may palliate the disease progression.

The terms "disease," "disorder," and "condition" are used interchangeably herein. These include, but are not limited to: respiratory complaints, obstructive pulmonary diseases of various origins, pulmonary emphysema of various origins, restrictive pulmonary diseases, interstitial pulmonary diseases, interstitial lung disease, cystic fibrosis, bronchitis of various origins, bronchiectasis, ARDS (adult respiratory distress syndrome) and all forms of pulmonary oedema; obstructive pulmonary diseases selected from among COPD (chronic obstructive pulmonary disease), asthma, bronchial asthma, paediatric asthma, severe asthma, acute asthma attacks and chronic bronchitis; pulmonary emphysema which has its origins in COPD (chronic obstructive pulmonary disease) or α1-proteinase inhibitor deficiency; restrictive pulmonary diseases selected from among allergic alveolitis, restrictive pulmonary diseases triggered by work-related noxious substances, such as asbestosis or silicosis, and restriction caused by lung tumours, such as lymphangiosis carcinomatosa, bronchoalveolar carcinoma and lymphomas; pneumonia caused by infections, such as for example infection by viruses, bacteria, fungi, protozoa, helminths or other pathogens, pneumonitis caused by various factors, such as for example aspiration and left heart insufficiency, radiation-induced pneumonitis or fibrosis, collagenoses, such as for example lupus erythematosus, systemic scleroderma or sarcoidosis, granulomatoses, such as for example Boeck's disease, idiopathic interstitial pneumonia or idiopathic pulmonary fibrosis (IPF); mucoviscidosis, bronchitis caused by bacterial or viral infection, allergic bronchitis and toxic bronchitis; bronchiectasis; pulmonary oedema, for example, toxic pulmonary oedema after aspiration or inhalation of toxic substances and foreign substances; rhinitis, arthritis and related arthropathies, psoriasis, myeloid leukemia, multiple sclerosis, Alzheimer's disease, glomerulonephritis, and chronic atopic dermatitis.

As used herein, the terms "treat," "treatment," and "treating" generally mean administration of a therapeutic to a subject in an attempt to obtain all or any of the following results: the reduction or amelioration of the progression, severity, and/or duration of a disease, disorder or condition associated with aberrant expression and/or activity of human GM-CSF or amelioration of one or more symptoms thereof resulting from the administration of one or more therapies (e.g., GM-CSF antibodies).

As used herein, the term "therapeutically effective amount" refers to the amount of a therapy (e.g., an antibody that immunospecifically binds to human GM-CSF), which is sufficient to reduce the severity of a disorder associated with aberrant expression and/or activity of human GM-CSF, reduce the duration of a disorder associated with aberrant expression and/or activity of human GM-CSF, ameliorate one or more symptoms of a disorder associated with aberrant expression and/or activity of human GM-CSF, prevent the advancement of a disorder associated with aberrant expression and/or activity of human GM-CSF, cause regression of a disorder associated with aberrant expression and/or activity of human GM-CSF, or enhance or improve the therapeutic effect(s) of another therapy for a disorder associated with aberrant expression and/or activity of human GM-CSF.

The amount of anti-hGM-CSF monoclonal antibody administered, such as by administering a composition described herein, will vary, depending on such considerations as the condition, disease or disorder being treated, the age, gender and health status of the subject (individual) receiving treatment and the severity of or the extent to which the condition, disease or disorder being treated has progressed. The appropriate dose can be determined empirically, using known methods and with reference to the needs of the subject. Typically, anti-hGM-CSF monoclonal antibody or antigen-binding fragment is administered to the subject at a dose not exceeding 500 mg/dose. Smaller doses can also be administered.

In other embodiments, any of the anti-GM-CSF antibodies and fragments as listed above may be combined. In some embodiments, 2, 3, 4, 5, or more of such anti-GM-CSF antibodies, fragments or combination thereof may be combined.

In some embodiments, any of the embodiments described above may be further combined with one or more of previously known anti-GM-CSF antibodies, fragments, or combination thereof.

Another embodiment is a therapeutic composition comprising an (one, at least one) anti-hGM-CSF monoclonal antibody or antigen-binding fragment thereof described herein. In one embodiment, a therapeutic composition comprises one or more anti-hGM-CSF monoclonal antibody or antigen-binding fragment that recognizes the following ELYK (SEQ ID NO: 2) and TMMASHYKQH (SEQ ID NO: 3) in hGM-CSF and a pharmaceutically acceptable carrier. Therapeutic compositions can comprise any of the anti-hGM-CSF monoclonal antibodies or antigen-binding fragment thereof described herein, individually (one kind or type of anti-hGM-CSF monoclonal antibody or antigen-binding fragment thereof in a therapeutic composition) or in combinations, such as combinations of two or more kinds or types of anti-hGM-CSF monoclonal antibodies; two or more kinds or types of antigen-binding fragments thereof; one or more kinds or types of anti-hGM-CSF monoclonal antibodies and one or more kinds or types of antigen-binding fragments thereof; one or more kinds or types of anti-hGM-CSF monoclonal antibodies and two or more kinds or types of antigen-binding fragments thereof; or two or more kinds or types of anti-hGM-CSF monoclonal antibodies and one or more kinds or types of antigen binding fragments thereof.

Specific embodiments are therapeutic compositions comprising an (one or more than one) anti-hGM-CSF monoclonal antibody or antigen-binding fragment thereof that binds to hGM-CSF and a pharmaceutically acceptable carrier, the antibody or antigen-binding fragment thereof comprising (a) a heavy chain or, in case of an antibody fragment, a part of a heavy chain, comprising (i) a consensus $V_H$-CDR1-containing sequence $FTFSX_1X_2MH$ (SEQ ID NO: 314), wherein $X_1$ is Y or H, and $X_2$ is G or A, (ii) a consensus $V_H$-CDR2-containing sequence $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, and (iii) a consensus $V_H$-CDR3-containing sequence $EX_nX_9GX_{10}X_nX_nDX_n$ (SEQ ID NO: 316), wherein each $X_n$ independently is any naturally occurring amino acid, $X_9$ is M or V, and $X_{10}$ is A or G; and (b) a light chain or, in case of an antibody fragment, a light chain or a part thereof, comprising (i) a consensus $V_L$-CDR1-containing sequence $X_nGNX_nX_nNIGSX_{11}AVG$ (SEQ ID NO: 317), wherein each $X_n$ independently is any naturally occurring amino acid, and $X_{11}$ is H or Y, (ii) a consensus $V_L$-CDR2-containing sequence $GX_{12}SPX_{13}SG$ (SEQ ID NO: 318), wherein $X_{12}$ is R or K, and $X_{13}$ is A or P, and (iii) a consensus $V_L$-CDR3-containing sequence $STWDSX_{14}LSAVX_{15}$ (SEQ ID NO: 319), wherein $X_{14}$ is R or S, and $X_{15}$ is V or L, wherein the anti-hGM-CSF monoclonal antibody or fragment thereof recognizes the following: ELYK (SEQ ID NO: 2) and TMMASHYKQH (SEQ ID NO: 3) in hGM-CSF.

Described herein are compositions comprising two or more anti-hGM-CSF monoclonal antibodies that bind to hGM-CSF, two or more antigen-binding fragments thereof that bind to hGM-CSF or a combination thereof and a pharmaceutically acceptable carrier, wherein one or more anti-hGM-CSF monoclonal antibodies or one or more antigen-binding fragments thereof recognize the discontinuous epitope ELYK (SEQ ID NO: 2) and TMMASHYKQH (SEQ ID NO: 3) in hGM-CSF.

A further embodiment described herein is a composition comprising two or more anti-hGM-CSF monoclonal antibodies that bind to hGM-CSF, two or more antigen-binding fragments thereof or a combination thereof and a pharmaceutically acceptable carrier, wherein one or more antibodies or one or more antigen-binding fragments thereof comprise (a) a heavy chain or, in case of an antibody fragment, a part of a heavy chain, comprising (i) a consensus $V_H$-CDR1-containing sequence $FTFSX_1X_2MH$ (SEQ ID NO: 314), wherein $X_1$ is Y or H, and $X_2$ is G or A, (ii) a consensus $V_H$-CDR2-containing sequence $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, and (iii) a consensus $V_H$-CDR3-containing sequence $EX_nX_9GX_{10}X_nX_nDX_n$ (SEQ ID NO: 316), wherein each $X_n$ independently is any naturally occurring amino acid, $X_9$ is M or V, and $X_{10}$ is A or G; and (b) a light chain or, in case of an antibody fragment, a light chain or a part thereof, comprising (i) a consensus $V_L$-CDR1-containing sequence $X_nGNX_nX_nNIGSX_{11}AVG$ (SEQ ID NO: 317), wherein each $X_n$ independently is any naturally occurring amino acid, and $X_{11}$ is H or Y, (ii) a consensus $V_L$-CDR2-containing sequence $GX_{12}SPX_{13}SG$ (SEQ ID NO: 318), wherein $X_{12}$ is R or K, and $X_{13}$ is A or P, and (iii) a consensus $V_L$-CDR3-containing sequence $STWDSX_{14}LSAVX_{15}$ (SEQ ID NO: 319), wherein $X_{14}$ is R or S, and $X_{15}$ is V or L, wherein the anti-hGM-CSF monoclonal antibody or fragment thereof recognizes the following ELYK (SEQ ID NO: 2) and TMMASHYKQH (SEQ ID NO: 3) in hGM-CSF.

Further subject matter described herein is a composition wherein at least one of the two or more anti-hGM-CSF monoclonal antibodies that bind to hGM-CSF comprises a polypeptide selected from the group consisting of SEQ ID NOs: 10-33, 38-80, 152-183, 34-37, 184-221, 222-245, 320-323 and 348-365. Compositions can include, in addition to one or more anti-hGM-CSF monoclonal antibodies described herein, other anti-hGM-CSF monoclonal antibodies, such as those previously described. See, e.g., PCT application International Publication Number WO2006/122797; PCT Application International Publication Number WO 2007/092939; and PCT application International Publication Number WO 2006/11353.

Kits

The anti-hGM-CSF antibodies or antigen-binding fragments thereof as disclosed herein, as well as the composition comprising such antibodies, may be provided as a kit, which is thus embraced by the present invention. A kit may be provided in a variety of formats and in addition to the medicament (therapeutic composition), may also include packaging and/or labeling of a drug or device usually resulting from a prescription order from a physician. A kit generally includes a printed instruction material for use. In some embodiments, the formulated composition (e.g., medicament) is provided in one or more container(s). In some embodiments, a container may be a device used to dispense the medicament for administration. For example, the medicament of the present invention may be pre-measured (e.g., aliquoted) into a single-use dispenser and provided as a kit. In some cases, the container is a syringe. The syringe may be optionally pre-filled. In some cases, single-use container is pre-filled, pre-sealed and disposable. Depending on administration routes and administration modes for a particular medicament, a kit may include suitable components.

Medicaments

As used herein, a "carrier acceptable for pharmaceutical agent" includes any or all of physiologically compatible solution, dispersion medium, coating agent, antimicrobial agent or antifungal agent, osmolar adjustment agent, and absorption retardant. Examples of the carrier acceptable for pharmaceutical agent includes one or plural kinds of agents such as water, salt solution, phosphate-buffered saline, dextrose, glycerol and ethanol and combinations thereof. In many cases, osmolar adjustment agent such as sugar, polyalchohol or sodium chloride is preferably included in the compositions. The polyalchohol may include mannitol or sorbitol. Furthermore, the carrier acceptable for pharmaceutical agent may include a small amount of auxiliary substances such as humectant, emulsifier, preservative, and buffer agent. The auxiliary substances may enhance preservation or effectivity in the compositions of anti-hGM-CSF monoclonal antibody or antigen-binding fragment thereof.

Medicinal compositions suitable for parenteral administration may incorporate the anti-hGM-CSF monoclonal antibody or antigen-binding fragment of the present invention therein. Preferably, the anti-hGM-CSF monoclonal antibody or antigen-binding fragment thereof is adjusted for the injectable solution containing the antibody at the amount of 0.1~250 mg/mL, when one kind of the anti-hGM-CSF monoclonal antibody or antigen-binding fragment thereof is applied. On the other hand, when the plural kinds of the antibodies are mixed and applied, the antibodies are preferably adjusted for the injective solution containing the antibodies at the amount of 0.001~10 mg/mL. Furthermore, the plural kinds of antibodies may be arbitrarily mixed in their any ratio.

The injectable solution formed in liquid or lyophilized dosage may be prepared in flint or amber vial, ampule, or prefilled syringe. As a buffering agent L-histidine may be used between pH 15.0~7.0 (pH 6.0 is the best suited). The L-histidine concentration of 5-10 mM may be the best suited. Other agents suitable for the buffering agent may be sodium succinate, sodium citrate, sodium phosphate, or potassium phosphate, but not limited to them. Sodium chloride may be applied to the buffering agent in order to remove toxicity in the solution at the concentration of 0~300 mM (regarding the dosage formed in the liquid, 150 mM is the best suited). The lyophilized dosage form may include a cryoprotectant; mainly sucrose at the ratio of 0~10% (the ratio of 0.5~1.0% may be the best suitable). Other agents suitable for the cryoprotectant may be trehalose and lactose. The lyophilized dosage form may include expander, mainly include mannitol at the ratio of 1~10% (the ratio of 2~4% may be the best suitable). As a stabilizer, mainly L-methionine at the concentration of 1~50 mM (5~10 mM may be the best suited) may be applied to both of the dosages formed in liquid or lyophilization. Glycine and arginine are included in the other appropriate expanders. Polysorbate 80 may be included as a surfactant at the ratio of 0~0.05% (the ratio of 0.005~0.01% may be the best suited). Other surfactant includes polysorbate 20 and BRIJ surfactant, but not limited to them.

Various dosage forms are applicable to the compositions in the present invention. For example, the compositions may have the dosages formed in liquid, semisolid, and solid. Solution (for example, injectable or transfusable solution), dispersion liquid, suspension liquid, tablet, pill, powder, liposome and suppository are included. Preferably, the dosage forms depend on the administration method and the therapeutic example. Preferably, the compositions have the dosages formed in liquid capable of injection and fluid transfusion. The compositions may be preferable for the parenteral administration (for example, intravenous administration, subcutaneous administration, abdominal administration, and intramuscular administration may be shown). In the preferred embodiment, the antibody is administered through intravenous infusion solution or intravenous injection. In another preferred embodiment, the antibody is administered through intramuscular injection or subcutaneous injection.

The compositions for therapies should be generally produced and stored under sterilized and stable condition. The compositions may be prescribed in solution, microemulsion, dispersion liquid, liposome or other structures suitable for the high drug concentration. The sterilized solution capable of injection is prepared by the following procedures. Required amount of active compounds (specifically, anti-hGM-CSF monoclonal antibody or antigen-binding fragment thereof) are mixed in appropriate solvent. If necessary, the one or the combination of the above-mentioned compounds is mixed in appropriate solvent together with the active compounds, and then sterilized by filtration so that the solution is prepared. Generally, fundamental dispersion medium and the active compounds are mixed in sterilized vehicle including other required compounds from the above-mentioned medium. When sterilized lyophilized powder is used to prepare the sterilized injectable solution, vacuum drying and spray drying method are preferably applied as the preparation methods. Through the preparation method, any other desirable compositions are obtained from the active ingredient powder and the sterilized solution applied for the filtration. The fluidity of the solution is appropriately sustained by the following means. The means are, for example, applying coating material such as lecithin, maintaining the particle size required for the dispersion liquid, and applying surfactant agent. Pharmaceutical absorption retardants such as monostearic acid and gelatin are included in the compositions, thereby the injectable compositions may be absorbed in human body for a long duration.

The anti-hGM-CSF monoclonal antibody or antigen-binding fragment thereof of the present invention may be administered through the various methods known in the art. The administration routes/methods such as subcutaneous injection, intravenous injection, or fluid transfusion are preferably applied in the various therapies. The administration routes/methods depend on the expected results. Those skilled in the art may understand that implant, percutaneous patch and drug delivery system are included in the administration routes/methods. In one embodiment, the antibody such as controlled release dosage, which may control the release of the compounds, is also applied together with the active compounds for the preparation. Biocompatible polymer has biodegradability. The preparation may include the biocompatible polymer such as ethylene vinyl acetate, polyanhydride, polyglycolic acid, collagen, polyortito esters, and polylactate. Various methods for preparing these dosages are granted as patents, and are generally known to those skilled in the art.

In one embodiment, the anti-hGM-CSF monoclonal antibody or antigen-binding fragment thereof is orally administered with, for example, the inactive diluent or edible and absorbable carrier. Compounds (and if desired, other ingredients) may also be encapsulated in hard or soft gelatin capsule, compressed in tablet, or directly mixed in food for the subject. In oral administration applied in the therapy, the compounds may be mixed in the excipient, and be used in the forms capable of the ingestion, such as tablet, buccal tablet, troche, capsule, elixir, suspension liquid, syrup, and oblate. In order to administer the compounds of the present invention by a route other than a parenteral route, it is necessary to coat the compounds in materials preventing their inactivation, and to administer the compounds and the materials at the same time.

Combination Therapy

It is also possible to supplementarily incorporate additional active compounds in the compositions, wherein the additional active compounds do not include an antibody against an antigen that is not GM-CSF. In one embodiment, the anti-hGM-CSF monoclonal antibody or antigen-binding fragment thereof in the present invention is prescribed with one or more kind of other therapeutic agents useful for remedying the diseases associated with elevated GM-CSF, or is administered with other therapeutic agents at the same time, where other therapeutic agents are not antibodies against a protein other than GM-CSF. For example, the anti-hGM-CSF monoclonal antibody or antigen-binding fragment thereof of the present invention is prescribed with one or more other anti-GM-CSF antibodies. The combination therapy has an advantage that the therapeutic agents work effectively in the small amount. The therapeutic agents enable to avoid the toxicity or complication, both of which might be accompanied with various monotherapies.

As used herein, "administered at the same time" shall be construed broadly. For example, when two or more kinds of anti GM-CSF monoclonal antibodies or antigen-binding fragments are administered to a patient, each or some of the antibodies or fragments thereof may or may not be provided as a single medicament (e.g., composition). In some embodiments, a single medicament (e.g., composition) comprises all of the different kinds of the anti GM-CSF monoclonal antibodies or antigen-binding fragments thereof that are administered to the subject, such that the antibodies or antigen-binding fragments thereof are simultaneously presented to the patient as a mixture. In some embodiments, however, two or more medicaments (e.g., compositions) comprising one or more kinds of antibodies or antigen-binding fragments are separately administered to the subject. When "separately" administered, the medicaments may be administered sequentially, e.g., one after another. It is construed to be administered "at the same time" as long as the effect of a first medicament and that of a subsequent medicament(s) (second, third, etc.) are overlapping in time and in target cells/tissues in the subject thereby effectuating an enhanced (e.g., synergistic) therapeutic outcome.

Especially, when more than one kind of the anti-hGM-CSF monoclonal antibodies of the present invention are applied, it is possible to provide cell growth-inhibiting activity (neutralizing bioactivity) which is much higher than that provided by one kind of monoclonal antibody in the medicinal composition. Therefore, it is possible to provide the required therapeutic agent in its smaller amount.

Accordingly, methods for enhancing activity are provided, characterized in that two or more kinds of anti GM-CSF monoclonal antibodies are administered at the same time, or the medicinal compositions or the veterinary drug compositions characterized in that two or more kinds of anti-hGM-CSF monoclonal antibody or antigen-binding fragment thereof are included, the two or more kinds of the antibodies selected from the following (a) and (b):

(a) anti-hGM-CSF monoclonal antibody or antigen-binding fragment thereof which have complementarity-determining regions (CDR) represented by amino acid sequences of SEQ ID NOs: 4 to 9, SEQ ID NOs: 330 to 335, SEQ ID NOs: 336 to 341, or SEQ ID NOs: 342 to 347, and which is specific for the hGM-CSF, (b) anti-hGM-CSF monoclonal antibody or antigen-binding fragment thereof of (a) which have an amino acid sequence in which one or more amino acids are substituted, deleted, inserted or added, and which is specific for hGM-CSF.

In the same way, the present invention also includes a method for enhancing activity characterized in that plural different kinds (described as "plural kinds" hereafter) of anti-hGM-CSF monoclonal antibodies of the invention are administered simultaneously, or the medicinal compositions or the veterinary drug compositions comprising the plural kinds of anti-hGM-CSF antibodies of the invention.

In any of the embodiments, the composition can comprise one kind or type of anti-hGM-CSF monoclonal antibodies or antigen-binding fragments thereof that are capable of neutralizing hGM-CSF activity. Alternatively, in any of the embodiments, the composition can comprise two or more kinds or types of anti-hGM-CSF monoclonal antibodies or antigen-binding fragments thereof that are capable of neutralizing hGM-CSF activity. The monoclonal antibodies and/or fragments thereof in such compositions can include, in addition to one or more antibody or fragment thereof disclosed herein, previously disclosed anti-hGM-CSF monoclonal antibodies and/or fragments thereof. The anti-hGM-CSF monoclonal antibodies and antigen-binding fragments thereof, and therapeutic compositions, medicinal compositions and pharmaceutical compositions comprising such antibodies and/or antigen binding fragments thereof can be used to treat or prevent diseases, disorders or conditions caused by hGM-CSF and/or associated with its over-expression (relative to hGM-CSF expression level in a control, such as an individual(s) who do not have the disease, condition or disorder).

Medicinal compositions including carriers pharmaceutically acceptable in the anti-hGM-CSF monoclonal antibody or antigen-binding fragment thereof are considered to be effective against the diseases caused by hGM-CSF. The diseases caused by the excessive production of the hGM-CSF may be illustrated such as (a) allergic disease such as asthma, atopy, and pollinosis, (b) graft rejection, graft-versus-host disease (GVHD) and (c) autoimmune disease such as rheumatoid arthritis.

Without intending to be limited to any particular mechanism, it is believed that over-expression of GM-CSF at least in part causes an array of diseases or disorders such as those listed herein. However, it is also possible that such clinical conditions may be caused by impairment in other related biological pathway(s), such as up-regulation of corresponding receptor(s) or mutations in one or more effector pathways. Thus, "disease or disorder associated with over-expression of hGM-CSF" shall include such conditions that lead to an equivalent outcome as hGM-CSF over-expression.

Manufacture/Preparation

In one embodiment the invention is an anti-hGM-CSF monoclonal antibody or antigen-binding fragment thereof as disclosed herein for use in medicine.

Use of an anti-hGM-CSF monoclonal antibody or antigen-binding fragment thereof, such as described herein, for the manufacture or preparation of a medicament for the treatment of a disease or disorder associated with over-expression of hGM-CSF (levels caused by GM-CSF, wherein the antibody or antigen-binding fragment thereof binds hGM-CSF and is capable of neutralizing hGM-CSF activity, is also an embodiment. Such anti-hGM-CSF monoclonal antibodies and antigen binding fragments thereof can be any described herein.

Use of an antibody or antigen-binding fragment thereof that recognizes ELYK (SEQ ID NO: 2) and TMMASHYKQH (SEQ ID NO: 3) in hGM-CSF for the manufacture or preparation of a medicament is a further embodiment.

A further embodiment is use of anti-hGM-CSF monoclonal antibodies and/or antigen-binding fragments thereof for the manufacture or preparation of a medicament, wherein the antibody or fragment thereof comprises (a) a heavy chain or, in case of an antibody fragment, a part of a heavy chain, comprising (i) a consensus $V_H$-CDR1-containing sequence $FTFSX_1X_2MH$ (SEQ ID NO: 314), wherein $X_1$ is Y or H, and $X_2$ is G or A, (ii) a consensus $V_H$-CDR2-containing sequence $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, and (iii) a consensus $V_H$-CDR3-containing sequence $EX_nX_9GX_{10}X_nX_nDX_n$ (SEQ ID NO: 316), wherein each $X_n$ independently is any naturally occurring amino acid, $X_9$ is M or V, and $X_{10}$ is A or G; and (b) a light chain or, in case of an antibody fragment, a light chain or a part thereof, comprising (i) a consensus $V_L$-CDR1-containing sequence $X_nGNX_nX_nNIGSX_{11}AVG$ (SEQ ID NO: 317), wherein each $X_n$ independently is any naturally occurring amino acid, and $X_{11}$ is H or Y, (ii) a consensus $V_L$-CDR2-containing sequence $GX_{12}SPX_{13}SG$ (SEQ ID NO: 318), wherein $X_{12}$ is R or K, and $X_{13}$ is A or P, and (iii) a consensus $V_L$-CDR3-containing sequence $STWDSX_{14}LSAVX_{15}$ (SEQ ID NO: 319), wherein $X_{14}$ is R or S, and $X_{15}$ is V or L.

In a further aspect, the invention provides isolated anti-hGM-CSF antibodies or antigen-binding fragments of such antibodies that are useful for the manufacture of medicaments. These medicaments are useful for the treatment of a disease, condition or disorder associated with aberrant expression (e.g., over-expression) of hGM-CSF. Any of the anti-hGM-CSF monoclonal antibodies or antigen-binding fragments thereof described herein can be used for the manufacture of a medicament for this purpose.

The antibodies or antigen-binding fragments recognize ELYK (SEQ ID NO: 2) and TMMASHYKQH (SEQ ID NO: 3) in hGM-CSF.

In certain embodiments, the antibody or antigen-binding fragment thereof comprises (a) a heavy chain or, in case of an antibody fragment, a part of a heavy chain, comprising (i) a consensus $V_H$-CDR1-containing sequence $FTFSX_1X_2MH$ (SEQ ID NO: 314), wherein $X_1$ is Y or H, and $X_2$ is G or A, (ii) a consensus $V_H$-CDR2-containing sequence $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, and (iii) a consensus $V_H$-CDR3-containing sequence $EX_nX_9GX_{10}X_nX_nDX_n$ (SEQ ID NO: 316), wherein each $X_n$ independently is any naturally occurring amino acid, $X_9$ is M or V, and $X_{10}$ is A or G; and (b) a light chain or, in case of an antibody fragment, a light chain or a part thereof, comprising (i) a consensus $V_L$-CDR1-containing sequence $X_nGNX_nX_nNIGSX_{11}AVG$ (SEQ ID NO: 317), wherein each $X_n$ independently is any naturally occurring amino acid, and $X_{11}$ is H or Y, (ii) a consensus $V_L$-CDR2-containing sequence $GX_{12}SPX_{13}SG$ (SEQ ID NO: 318), wherein $X_{12}$ is R or K, and $X_{13}$ is A or P, and (iii) a consensus $V_L$-CDR3-containing sequence $STWDSX_{14}LSAVX_{15}$ (SEQ ID NO: 319), wherein $X_{14}$ is R or S, and $X_{15}$ is V or L. In one embodiment, the antibody or antigen-binding fragment thereof binds to hGM-CSF with a $K_D$ of not more than 400 pM, in another embodiment less than about 160 pM (such as EV1018 or EV1019), whereby the $K_D$ is determined in accordance with the techniques described in the Examples.

In other embodiments, any of the anti-GM-CSF antibodies and fragments as listed above may be combined. In some embodiments, 2, 3, 4, 5, or more of such anti-GM-CSF antibodies, fragments or combination thereof may be combined.

Production of Antibodies and Fragments, of DNA and Vectors

Described below is the production of the originator antibody recognizing the discontinuous epitope provided in the invention; however, it should not be construed to be limiting to the particular method. The described features may be substituted in the technology field without departing from the scope of the invention.

Anti-hGM-CSF monoclonal antibody and its antigen-binding portion of the present invention were derived from the blood obtained from an idiopathic alveolar proteinosis patient through the following steps: isolating a cell clone to produce the antibody, selecting an antibody-positive cell from the obtained library of antibody-producing cells, and purifying the antibody obtained from the supernatant of the antibody-positive cell by affinity purification.

1) Separation of Fully Human Antibody-Producing Cell Clone Against hGM-CSF.

B-lymphocyte is isolated from the blood of a patient, who is suffering from idiopathic alveolar proteinosis (IPAP) and has high level of anti-hGM-CSF monoclonal antibody in the blood serum. Then, the B-lymphocyte is induced for its proliferation. The method for inducing its proliferation is well known. As the example, an inducible factor of cancer, "Epstein-Barr virus" (described as EBV hereinafter) is applied in the transform method (D. Kozbor et al.) for the induced proliferation. More specifically, B-lymphocyte is infected with EBV, and is induced for its proliferation. The proliferated cells are kept for a library of the antibody-producing cells.

2) Isolation of the Monoclonal Antibody from the Library of the Antibody-Producing Cells.

Using the known method commonly applied in producing monoclonal antibodies, a monoclonal cell is selected out of the induced-proliferated cells.

From the library of the antibody-producing cells, the lymphocyte is selected in order to produce the antibody which binds to hGM-CSF. More specifically, cell population (clones) producing antibody that binds to hGM-CSF is selected by limiting dilution method. It is preferable to employ ELISA using hGM-CSF and mouse anti-hIgG antibody labeled for detecting a fraction binding to hGM-CSF. The cell population (clones) that produces only the desired antibody is obtained by cultivating the selected antibody-positive cell and screening them repeatedly. The steps until the "isolating an antibody-producing cell clone" are illustrated in a flow chart shown in FIG. 1.

3) Affinity Purification Using Protein A or Protein G

When purifying the anti-hGM-CSF monoclonal antibody, it is possible to cultivate the selected immortalized cell in a roller bottle, 2-liter spinner flask, or other cultivating systems. The supernatant is filtrated and concentrated. Then, the protein is purified by affinity chromatography with Protein A-Sepharose or Protein G-Sepharose etc, (New Jersey, Piscataway, Pharmacia Corp.). After the exchange of the buffering solution to PBS, the concentration of the protein is measured by OD at 280 nm, or preferably by nephelometer analysis. The antibody isotype is examined by antigen-specific method against isotype antigen.

The obtained anti-hGM-CSF monoclonal antibody is a complete human antibody produced from B-lymphocyte sensitized in human body, thereby the anti-hGM-CSF monoclonal antibody rarely shows the immunoreaction against antibody. While the antibody-producing cell is cloned, B-lymphocyte is infected with EB virus, and induced its proliferation by the EB virus activity. Accordingly, it is characterized that the antibody-producing cell is cloned by applying such the EB virus activity. The EB virus method has an advantage in producing a natural antibody in a human body, and in obtaining antibody with high affinity. For example, the affinity of the anti-hGM-CSF monoclonal antibody is 10-100 times as high as an antibody produced by artificially-immunized mouse. A library includes a group of the B-lymphocytes proliferated by the EB virus infection. It is possible to isolate a specific antibody-producing cell clone from the library and obtain a human antibody.

As mentioned above, the described features may be substituted or converted in the technology field without departing from the scope of the invention. A nucleic acid, a vector and a host cell may express recombinant antibody or its antigen binding portion in the present invention. These are also included in the present invention.

Shown in the tables below are the heavy chain variants and the light chain variants of EV1018 and the heavy chain variants and the light chain variants of EV1019. The tables provide, respectively, the variants for the heavy and light chains of EV1018 and the variants for the heavy and light chains of EV1019 and make it possible to identify all possible combinations of a heavy chain and a light for each of EV1018 and EV1019. One of ordinary skill in the art can produce any of the combinations, using methods known in the art and information provided herein.

In a further aspect, a process (method) for producing an anti-hGM-CSF monoclonal antibody or antigen-binding fragment thereof is disclosed herein. Typically, a method for producing an anti-hGM-CSF monoclonal antibody or an antigen-binding fragment thereof comprising obtaining or producing DNA consisting essentially of DNA encoding an immunoglobulin consisting of a heavy chain and a light chain or Fab region; inserting the DNA produced into a replicable expression vector in such a manner that it is operably linked to a suitable promoter, thereby producing a vector comprising the DNA operably linked to a suitable promoter; introducing the vector into a host cell, thereby producing a host cell containing the vector; culturing the host cell under conditions suitable for expression of the DNA and production of the encoded peptide(s) and the anti-hGM-CSF monoclonal antibody or antigen-binding fragment. The resulting anti-hGM-CSF monoclonal antibody or antigen-binding fragment can be recovered from the host cell or host cell culture by methods known in the art.

More specifically, the process comprises producing at least $V_H$-CDR1, $V_H$-CDR2 and $V_H$-CDR3, and $V_L$-CDR1, $V_L$-CDR2 and $V_L$-CDR3 in a host cell. The method comprises introducing into an appropriate host cell DNA encoding $V_H$-CDR1, $V_H$-CDR2, $V_H$-CDR3, $V_L$-CDR1, $V_L$-CDR2 and $V_L$-CDR3, maintaining the resulting host cell (host cell containing DNA encoding $V_H$-CDR1, $V_H$-CDR2, $V_H$-CDR3, $V_L$-CDR1, $V_L$-CDR2, $V_L$-CDR3) under conditions appropriate for expression of the DNA (production of the encoded peptides), and formation/assembly of the anti-hGM-CSF monoclonal antibody or antigen-binding fragment thereby producing the anti-hGM-CSF monoclonal antibody or antigen binding fragment. In specific embodiments, the anti-hGM-CSF monoclonal antibody or antigen binding fragment thereof includes (a) a heavy chain or, in case of an antibody fragment, a part of a heavy chain, comprising (i) a consensus $V_H$-CDR1-containing sequence FTFS$X_1X_2$MH (SEQ ID NO: 314), wherein $X_1$ is Y or H, and $X_2$ is G or A, (ii) a consensus $V_H$-CDR2-containing sequence $X_3X_4X_5$H$X_n$G$X_n$$X_6$K$X_7$YADSV$X_8$G (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, and (iii) a consensus $V_H$-CDR3-containing sequence E$X_n$$X_9$G$X_{10}$$X_n$$X_n$D$X_n$ (SEQ ID NO: 316), wherein each $X_n$ independently is any naturally occurring amino acid, $X_9$ is M or V, and $X_{10}$ is A or G; and (b) a light chain or, in case of an antibody fragment, a light chain or a part thereof, comprising (i) a consensus $V_L$-CDR1-containing sequence $X_n$GN$X_n$$X_n$NIGS$X_{11}$AVG (SEQ ID NO: 317), wherein each $X_n$ independently is any naturally occurring amino acid, and $X_{11}$ is H or Y, (ii) a consensus $V_L$-CDR2-containing sequence G$X_{12}$SP$X_{13}$SG (SEQ ID NO: 318), wherein $X_{12}$ is R or K, and $X_{13}$ is A or P, and (iii) a consensus $V_L$-CDR3-containing sequence STWDS$X_{14}$LSAV$X_{15}$ (SEQ ID NO: 319), wherein $X_{14}$ is R or S, and $X_{15}$ is V or L; and the anti-hGM-CSF monoclonal antibody or antigen-binding fragment produced binds hGM-CSF. DNA encoding $V_H$-CDR1, $V_H$-CDR2, $V_H$-CDR3, $V_L$-

CDR1, $V_L$-CDR2 and $V_L$-CDR3 can be one or multiple units (e.g., all of the $V_H/V_L$ components can be encoded by one DNA, some or all components can be encoded by separate DNA).

For example, a first DNA can encode a complete heavy chain and a second DNA can encode a complete light chain. The complete heavy chain can be selected from the group consisting of SEQ ID NOs: 10-33, 38-80 and 160-183; 222-245, 320 and 322 and the complete light chain can be selected from the group consisting of SEQ ID NOs: 34-37, 202-221, 321 and 323. In one embodiment the complete heavy chain is selected from the group consisting of SEQ ID NOs: 10-33, 38-80 and 160-183; 222-245, 320 and 322 and the complete light chain is selected from the group consisting of SEQ ID NOs: 34-37, 202-221, 321 and 323.

The process can further comprise isolating the anti-hGM-CSF monoclonal antibody or antigen-binding fragment thereof.

Also the subject herein is a vector comprising DNA encoding a $V_H$-CDR1, and/or a $V_H$-CDR2, and/or a $V_H$-CDR3. $V_H$-CDR1 is SYGMH (SEQ ID NO: 4) or SHAMH (SEQ ID NO: 333), $V_H$-CDR2 is LTYHHGNRKFYADSVRG (SEQ ID NO: 5) or VIWHDGSKKYYADSVKG (SEQ ID NO: 334), and $V_H$-CDR3 is ESMGAINDN (SEQ ID NO: 6) or EWVGGTCDS (SEQ ID NO: 335).

Also the subject herein is a vector comprising DNA encoding a $V_L$-CDR1, a $V_L$-CDR2, and a $V_L$-CDR3, wherein $V_L$-CDR1 is IGNNNNIGSHAVG (SEQ ID NO: 7) or SGNSSNIGSYAVG (SEQ ID NO: 330), $V_L$-CDR2 is GRSPPS (SEQ ID NO: 8) or GKSPAS (SEQ ID NO: 331), and $V_L$-CDR3 is STWDSSLSAVV (SEQ ID NO: 9) or STWDSRLSAVL (SEQ ID NO: 332).

For example, the leader sequences of the heavy chain and light chain are cleaved in the protein maturation process. The cleaved leader sequences have no effect on the final antibody properties. To complement the deleted sequence, the cloned cDNA is integrated with the synthetic oligonucleotide in ligation or PCR amplification method. The terms "leader sequence" and "signal sequence" are used interchangeably herein.

In an alternative process, a whole variable region is synthesized with a pair of short overlapping oligonucleotides, and then the resulting oligonucleotide is amplified in a PCR amplification method, so that an artificial clone of a variable region is entirely obtained.

Another aspect of the present invention relates to an isolated deoxyribonucleic acid (DNA) coding the anti-hGM-CSF monoclonal antibody or antigen-binding fragment thereof capable of binding to hGM-CSF and neutralizing bioactivity of the hGM-CSF, wherein the isolated DNA comprises a nucleotide sequence coding an amino acid sequence comprising at least one selected from the group consisting of SEQ ID NOs: 4 to 9. This invention also includes the isolated DNA in which a nucleotide sequence codes an amino acid sequence comprising at least one selected from the group consisting of SEQ ID NOs: 330 to 335.

When an isolated deoxyribonucleic acid (DNA) codes the anti-hGM-CSF monoclonal antibody or antigen-binding fragment thereof capable of binding to hGM-CSF and neutralizing bioactivity of the hGM-CSF, following anti-hGM-CSF monoclonal antibody or antigen-binding fragment thereof is also incorporated in the present invention:

the isolated DNA capable of hybridizing with the DNA described above under stringent condition.

Following vector and host cell is also incorporated in the present invention:

1) A vector incorporating the isolated DNA

2) A host cell integrated with the recombinant expression vector.

Furthermore, it is also possible to obtain a specific antibody by expressing a diversified scFv (single-chain Fragment of variable region) antibody prepared by artificially shuffling $V_H$ and $V_L$ genes as phage fusion protein, using a recently-developed phage display method which utilizes genetic engineering technique to express a recombinant antibody on the phage surface.

An antibody fragment according to the invention can be obtained by any method known to the skilled worker, e.g. recombinant expression of fragments which are encoded by truncated forms of the DNA coding for the antibody, or by proteolytic degradation of the antibody amino acid chains, whereby the skilled worker applies standard biological assays, e.g. as those described herein, for determining which of the fragments maintained the antigen-binding function or neutralizing activity.

Specific Antibodies of the Invention

The invention provides the EV1018 antibody itself and numerous variations (e.g., variants) of the EV1018 antibody, as summarized in Table A. In certain embodiments, a heavy chain contains one or more amino acid substitutions relative to the wild type heavy chain sequence. In some embodiments, a light chain contains one or more amino acid substitutions relative to the wild type EV1018 light chain sequence. In some embodiments, a heavy chain and a light chain each contain one or more amino acid substitutions.

In some embodiments, the antibody or antigen-binding fragment thereof comprises the light chain, EV1018-wt-original (SEQ ID NO: 34), and one of the following heavy chain variants: EV1018 (SEQ ID NO: 10), EV1018-wt-IgG1KO (SEQ ID NO: 11), EV1018-T97A-IgG1KO(SEQ ID NO: 12), EV1018-T97V-IgG1KO(SEQ ID NO: 13), EV1018-N95D-IgG1KO(SEQ ID NO: 14), EV1018-N95E IgG1KO(SEQ ID NO: 15), EV1018-N95K IgG1KO (SEQ ID NO: 16), EV1018-N95Q IgG1KO (SEQ ID NO: 17), EV1018-N93Q-N95T IgG1KO (SEQ ID NO: 18), EV1018-wt IgG1-BI (SEQ ID NO: 19), EV1018-T97A IgG1-BI (SEQ ID NO: 20), EV1018-T97V IgG1-BI (SEQ ID NO: 21), EV1018-N95D IgG1-BI (SEQ ID NO: 22), EV1018-N95E IgG1-BI (SEQ ID NO: 23), EV1018-N95K IgG1-BI (SEQ ID NO: 24), EV1018-N95Q IgG1-BI (SEQ ID NO: 25), EV1018-N93Q-N95T IgG1-BI (SEQ ID NO: 26), EV1018-T97A IgG1-original-constant (SEQ ID NO: 27), EV1018-T97V IgG1-original-constant (SEQ ID NO: 28), EV1018-N95D IgG1-original-constant (SEQ ID NO: 29), EV1018-N95E IgG1-original-constant (SEQ ID NO: 30), EV1018-N95K IgG1-original-constant (SEQ ID NO: 31), EV1018-N95Q IgG1-original-constant (SEQ ID NO: 32), EV1018-N93Q-N95T IgG1-original-constant (SEQ ID NO: 33), EV1018-wt-IgG1-KO-QVQL (SEQ ID NO: 38), EV1018-T97A-IgG1-KO-QVQL (SEQ ID NO: 39), EV1018-T97V-IgG1-KO-QVQL (SEQ ID NO: 40), EV1018-N95D-IgG1-KO-QVQL (SEQ ID NO: 41), EV1018-N95E IgG1-KO-QVQL (SEQ ID NO: 42), EV1018-N95K IgG1-KO-QVQL (SEQ ID NO: 43), EV1018-N95Q IgG1-KO-QVQL (SEQ ID NO: 44), EV1018-N93Q-N95T IgG1-KO-QVQL (SEQ ID NO: 45), EV1018-wt IgG1-QVQL-BI (SEQ ID NO:46), EV1018-T97A IgG1-QVQL-BI (SEQ ID NO: 47), EV1018-T97V IgG1-QVQL-BI (SEQ ID NO: 48), EV1018-N95D IgG1-QVQL-BI (SEQ ID NO: 49), EV1018-N95E IgG1-QVQL-BI (SEQ ID NO: 50), EV1018-N95K IgG1-QVQL-BI (SEQ ID NO: 51), EV1018-N95Q IgG1-QVQL-BI (SEQ ID NO: 52), EV1018-N93Q-N95T IgG1-QVQL-BI (SEQ ID NO: 53), EV1018-IgG2 (SEQ ID NO: 54), EV1018-wt-IgG2 (SEQ ID NO: 55), EV1018-T97A-IgG2 (SEQ ID NO: 56), EV1018-T97V-IgG2 (SEQ ID NO: 57), EV1018-N95D-IgG2 (SEQ ID NO: 58), EV1018-N95E-IgG2 (SEQ ID NO: 59), EV1018-N95K-IgG2 (SEQ ID NO: 60), EV1018-N95Q-IgG2 (SEQ ID NO: 61), EV1018-N93Q-N95T-IgG2 (SEQ ID NO: 62), EV1018-IgG4 (SEQ ID NO: 63), EV1018-wt-IgG4 (SEQ ID NO: 64), EV1018-T97A-IgG4 (SEQ ID NO: 65), EV1018-T97V-IgG4 (SEQ ID NO: 66), EV1018-N95D-IgG4 (SEQ ID NO: 67), EV1018-N95E-IgG4 (SEQ ID NO: 68), EV1018-N95K-IgG4 (SEQ ID NO: 69), EV1018-N95Q-IgG4 (SEQ ID NO: 70), EV1018-N93Q-N95T-IgG4 (SEQ ID NO: 71), EV1018-IgG4-SP (SEQ ID NO: 72), EV1018-wt-IgG4-SP (SEQ ID NO: 73), EV1018-T97A-IgG4-SP (SEQ ID NO: 74), EV1018-T97V-IgG4-SP (SEQ ID NO: 75), EV1018-N95D-IgG4-SP (SEQ ID NO: 76), EV1018-N95E-IgG4-SP (SEQ ID NO: 77), EV1018-N95K-IgG4-SP (SEQ ID NO: 78), EV1018-N95Q-IgG4-SP (SEQ ID NO: 79) and EV1018-N93Q-N95T-IgG4-SP (SEQ ID NO: 80).

In some embodiments, the antibody or antigen-binding fragment thereof comprises the light chain, EV1018-wt-BI (SEQ ID NO: 35), and one of the following heavy chain variants: EV1018 (SEQ ID NO: 10), EV1018-wt-IgG1KO (SEQ ID NO: 11), EV1018-T97A-IgG1KO (SEQ ID NO: 12), EV1018-T97V-IgG1KO(SEQ ID NO: 13), EV1018-N95D-IgG1KO (SEQ ID NO: 14), EV1018-N95E IgG1KO (SEQ ID NO: 15), EV1018-N95K IgG1KO (SEQ ID NO: 16), EV1018-N95Q IgG1KO (SEQ ID NO: 17), EV1018-N93Q-N95T IgG1KO (SEQ ID NO: 18), EV1018-wt IgG1-BI (SEQ ID NO: 19), EV1018-T97A IgG1-BI (SEQ ID NO: 20), EV1018-T97V IgG1-BI (SEQ ID NO: 21), EV1018-N95D IgG1-BI (SEQ ID NO: 22), EV1018-N95E IgG1-BI (SEQ ID NO: 23), EV1018-N95K IgG1-BI (SEQ ID NO: 24), EV1018-N95Q IgG1-BI (SEQ ID NO: 25), EV1018-N93Q-N95T IgG1-BI (SEQ ID NO: 26), EV1018-T97A IgG1-original-constant (SEQ ID NO: 27), EV1018-T97V IgG1-original-constant (SEQ ID NO: 28), EV1018-N95D IgG1-original-constant (SEQ ID NO: 29), EV1018-N95E IgG1-original-constant (SEQ ID NO: 30), EV1018-N95K IgG1-original-constant (SEQ ID NO: 31), EV1018-N95Q IgG1-original-constant (SEQ ID NO: 32), EV1018-N93Q-N95T IgG1-original-constant (SEQ ID NO: 33), EV1018-wt-IgG1-KO-QVQL (SEQ ID NO: 38), EV1018-T97A-IgG1-KO-QVQL (SEQ ID NO: 39), EV1018-T97V-IgG1-KO-QVQL (SEQ ID NO: 40), EV1018-N95D-IgG1-KO-QVQL (SEQ ID NO: 41), EV1018-N95E IgG1-KO-QVQL (SEQ ID NO: 42), EV1018-N95K IgG1-KO-QVQL (SEQ ID NO: 43), EV1018-N95Q IgG1-KO-QVQL (SEQ ID NO: 44), EV1018-N93Q-N95T IgG1-KO-QVQL (SEQ ID NO: 45), EV1018-wt IgG1-QVQL-BI (SEQ ID NO:46), EV1018-T97A IgG1-QVQL-BI (SEQ ID NO: 47), EV1018-T97V IgG1-QVQL-BI (SEQ ID NO: 48), EV1018-N95D IgG1-QVQL-BI (SEQ ID NO: 49), EV1018-N95E IgG1-QVQL-BI (SEQ ID NO: 50), EV1018-N95K IgG1-QVQL-BI (SEQ ID NO: 51), EV1018-N95Q IgG1-QVQL-BI (SEQ ID NO: 52), EV1018-N93Q-N95T IgG1-QVQL-BI (SEQ ID NO: 53), EV1018-IgG2 (SEQ ID NO: 54), EV1018-wt-IgG2 (SEQ ID NO: 55), EV1018-T97A-IgG2 (SEQ ID NO: 56), EV1018-T97V-IgG2 (SEQ ID NO: 57), EV1018-N95D-IgG2 (SEQ ID NO: 58), EV1018-N95E-IgG2 (SEQ ID NO: 59), EV1018-N95K-IgG2 (SEQ ID NO: 60), EV1018-N95Q-IgG2 (SEQ ID NO: 61), EV1018-N93Q-N95T-IgG2 (SEQ ID NO: 62), EV1018-IgG4 (SEQ ID NO: 63), EV1018-wt-IgG4 (SEQ ID NO: 64), EV1018-T97A-IgG4 (SEQ ID NO: 65), EV1018-T97V-IgG4 (SEQ ID NO: 66), EV1018-N95D-IgG4 (SEQ ID NO: 67), EV1018-N95E-IgG4 (SEQ ID NO: 68), EV1018-N95K-IgG4 (SEQ ID NO: 69), EV1018-N95Q-IgG4 (SEQ ID NO: 70), EV1018-N93Q-N95T-IgG4 (SEQ ID NO: 71), EV1018-IgG4-SP (SEQ ID NO: 72), EV1018-wt-IgG4-SP (SEQ ID NO: 73), EV1018-T97A-IgG4-SP (SEQ ID NO: 74), EV1018-T97V-IgG4-SP (SEQ ID NO: 75), EV1018-N95D-IgG4-SP (SEQ ID NO: 76), EV1018-N95E-IgG4-SP (SEQ ID NO: 77), EV1018-N95K-IgG4-SP (SEQ ID NO: 78), EV1018-N95Q-IgG4-SP (SEQ ID NO: 79) and EV1018-N93Q-N95T-IgG4-SP (SEQ ID NO: 80).

In some embodiments, the antibody or antigen-binding fragment thereof comprises the light chain, EV1018-wt-BI2 (G1) (SEQ ID NO: 36), and one of the following heavy chain variants: EV1018 (SEQ ID NO: 10), EV1018-wt-IgG1KO (SEQ ID NO: 11), EV1018-T97A-IgG1KO (SEQ ID NO: 12), EV1018-T97V-IgG1KO (SEQ ID NO: 13), EV1018-N95D-IgG1KO (SEQ ID NO: 14), EV1018-N95E IgG1KO (SEQ ID NO: 15), EV1018-N95K IgG1KO (SEQ ID NO: 16), EV1018-N95Q IgG1KO (SEQ ID NO: 17), EV1018-N93Q-N95T IgG1KO (SEQ ID NO: 18), EV1018-wt IgG1-BI (SEQ ID NO: 19), EV1018-T97A IgG1-BI (SEQ ID NO: 20), EV1018-T97V IgG1-BI (SEQ ID NO: 21), EV1018-N95D IgG1-BI (SEQ ID NO: 22), EV1018-N95E IgG1-BI (SEQ ID NO: 23), EV1018-N95K IgG1-BI (SEQ ID NO: 24), EV1018-N95Q IgG1-BI (SEQ ID NO: 25), EV1018-N93Q-N95T IgG1-BI (SEQ ID NO: 26), EV1018-T97A IgG1-original-constant (SEQ ID NO: 27), EV1018-T97V IgG1-original-constant (SEQ ID NO: 28), EV1018-N95D IgG1-original-constant (SEQ ID NO: 29), EV1018-N95E IgG1-original-constant (SEQ ID NO: 30), EV1018-N95K IgG1-original-constant (SEQ ID NO: 31), EV1018-N95Q IgG1-original-constant (SEQ ID NO: 32), EV1018-N93Q-N95T IgG1-original-constant (SEQ ID NO: 33), EV1018-wt-IgG1-KO-QVQL (SEQ ID NO: 38), EV1018-T97A-IgG1-KO-QVQL (SEQ ID NO: 39), EV1018-T97V-IgG1-KO-QVQL (SEQ ID NO: 40), EV1018-N95D-IgG1-KO-QVQL (SEQ ID NO: 41), EV1018-N95E IgG1-KO-QVQL (SEQ ID NO: 42), EV1018-N95K IgG1-KO-QVQL (SEQ ID NO: 43), EV1018-N95Q IgG1-KO-QVQL (SEQ ID NO: 44), EV1018-N93Q-N95T IgG1-KO-QVQL (SEQ ID NO: 45), EV1018-wt IgG1-QVQL-BI (SEQ ID NO:46), EV1018-T97A IgG1-QVQL-BI (SEQ ID NO: 47), EV1018-T97V IgG1-QVQL-BI (SEQ ID NO: 48), EV1018-N95D IgG1-QVQL-BI (SEQ ID NO: 49), EV1018-N95E IgG1-QVQL-BI (SEQ ID NO: 50), EV1018-N95K IgG1-QVQL-BI (SEQ ID NO: 51), EV1018-N95Q IgG1-QVQL-BI (SEQ ID NO: 52), EV1018-N93Q-N95T IgG1-QVQL-BI (SEQ ID NO: 53), EV1018-IgG2 (SEQ ID NO: 54), EV1018-wt-IgG2 (SEQ ID NO: 55), EV1018-T97A-IgG2 (SEQ ID NO: 56), EV1018-T97V-IgG2 (SEQ ID NO: 57), EV1018-N95D-IgG2 (SEQ ID NO: 58), EV1018-N95E-IgG2 (SEQ ID NO: 59), EV1018-N95K-IgG2 (SEQ ID NO: 60), EV1018-N95Q-IgG2 (SEQ ID NO: 61), EV1018-N93Q-N95T-IgG2 (SEQ ID NO: 62), EV1018-IgG4 (SEQ ID NO: 63), EV1018-wt-IgG4 (SEQ ID NO: 64), EV1018-T97A-IgG4 (SEQ ID NO: 65), EV1018-T97V-IgG4 (SEQ ID NO: 66), EV1018-N95D-IgG4 (SEQ ID NO: 67), EV1018-N95E-IgG4 (SEQ ID NO: 68), EV1018-N95K-IgG4 (SEQ ID NO: 69), EV1018-N95Q-IgG4 (SEQ ID NO: 70), EV1018-N93Q-N95T-IgG4 (SEQ ID NO: 71), EV1018-IgG4-SP (SEQ ID NO: 72), EV1018-wt-IgG4-SP (SEQ ID NO: 73), EV1018-T97A-IgG4-SP (SEQ ID NO: 74), EV1018-T97V-IgG4-SP (SEQ ID NO: 75), EV1018-N95D-IgG4-SP (SEQ ID NO: 76), EV1018-N95E-IgG4-SP (SEQ ID NO: 77), EV1018-

N95K-IgG4-SP (SEQ ID NO: 78), EV1018-N95Q-IgG4-SP (SEQ ID NO: 79) and EV1018-N93Q-N95T-IgG4-SP (SEQ ID NO: 80).

In some embodiments, the antibody or antigen-binding fragment thereof comprises the light chain, EV1018-wt-original-constant (SEQ ID NO: 37), and one of the following heavy chain variants: EV1018 (SEQ ID NO: 10), EV1018-wt-IgG1KO (SEQ ID NO: 11), EV1018-T97A-IgG1KO (SEQ ID NO: 12), EV1018-T97V-IgG1KO (SEQ ID NO: 13), EV1018-N95D-IgG1KO (SEQ ID NO: 14), EV1018-N95E IgG1KO (SEQ ID NO: 15), EV1018-N95K IgG1KO (SEQ ID NO: 16), EV1018-N95Q IgG1KO (SEQ ID NO: 17), EV1018-N93Q-N95T IgG1KO (SEQ ID NO: 18), EV1018-wt IgG1-BI (SEQ ID NO: 19), EV1018-T97A IgG1-BI (SEQ ID NO: 20), EV1018-T97V IgG1-BI (SEQ ID NO: 21), EV1018-N95D IgG1-BI (SEQ ID NO: 22), EV1018-N95E IgG1-BI (SEQ ID NO: 23), EV1018-N95K IgG1-BI (SEQ ID NO: 24), EV1018-N95Q IgG1-BI (SEQ ID NO: 25), EV1018-N93Q-N95T IgG1-BI (SEQ ID NO: 26), EV1018-T97A IgG1-original-constant (SEQ ID NO: 27), EV1018-T97V IgG1-original-constant (SEQ ID NO: 28), EV1018-N95D IgG1-original-constant (SEQ ID NO: 29), EV1018-N95E IgG1-original-constant (SEQ ID NO: 30), EV1018-N95K IgG1-original-constant (SEQ ID NO: 31), EV1018-N95Q IgG1-original-constant (SEQ ID NO: 32), EV1018-N93Q-N95T IgG1-original-constant (SEQ ID NO: 33), EV1018-wt-IgG1-KO-QVQL (SEQ ID NO: 38), EV1018-T97A-IgG1-KO-QVQL (SEQ ID NO: 39), EV1018-T97V-IgG1-KO-QVQL (SEQ ID NO: 40), EV1018-N95D-IgG1-KO-QVQL (SEQ ID NO: 41), EV1018-N95E IgG1-KO-QVQL (SEQ ID NO: 42), EV1018-N95K IgG1-KO-QVQL (SEQ ID NO: 43), EV1018-N95Q IgG1-KO-QVQL (SEQ ID NO: 44), EV1018-N93Q-N95T IgG1-KO-QVQL (SEQ ID NO: 45), EV1018-wt IgG1-QVQL-BI (SEQ ID NO:46), EV1018-T97A IgG1-QVQL-BI (SEQ ID NO: 47), EV1018-T97V IgG1-QVQL-BI (SEQ ID NO: 48), EV1018-N95D IgG1-QVQL-BI (SEQ ID NO: 49), EV1018-N95E IgG1-QVQL-BI (SEQ ID NO: 50), EV1018-N95K IgG1-QVQL-BI (SEQ ID NO: 51), EV1018-N95Q IgG1-QVQL-BI (SEQ ID NO: 52), EV1018-N93Q-N95T IgG1-QVQL-BI (SEQ ID NO: 53), EV1018-IgG2 (SEQ ID NO: 54), EV1018-wt-IgG2 (SEQ ID NO: 55), EV1018-T97A-IgG2 (SEQ ID NO: 56), EV1018-T97V-IgG2 (SEQ ID NO: 57), EV1018-N95D-IgG2 (SEQ ID NO: 58), EV1018-N95E-IgG2 (SEQ ID NO: 59), EV1018-N95K-IgG2 (SEQ ID NO: 60), EV1018-N95Q-IgG2 (SEQ ID NO: 61), EV1018-N93Q-N95T-IgG2 (SEQ ID NO: 62), EV1018-IgG4 (SEQ ID NO: 63), EV1018-wt-IgG4 (SEQ ID NO: 64), EV1018-T97A-IgG4 (SEQ ID NO: 65), EV1018-T97V-IgG4 (SEQ ID NO: 66), EV1018-N95D-IgG4 (SEQ ID NO: 67), EV1018-N95E-IgG4 (SEQ ID NO: 68), EV1018-N95K-IgG4 (SEQ ID NO: 69), EV1018-N95Q-IgG4 (SEQ ID NO: 70), EV1018-N93Q-N95T-IgG4 (SEQ ID NO: 71), EV1018-IgG4-SP (SEQ ID NO: 72), EV1018-wt-IgG4-SP (SEQ ID NO: 73), EV1018-T97A-IgG4-SP (SEQ ID NO: 74), EV1018-T97V-IgG4-SP (SEQ ID NO: 75), EV1018-N95D-IgG4-SP (SEQ ID NO: 76), EV1018-N95E-IgG4-SP (SEQ ID NO: 77), EV1018-N95K-IgG4-SP (SEQ ID NO: 78), EV1018-N95Q-IgG4-SP (SEQ ID NO: 79) and EV1018-N93Q-N95T-IgG4-SP (SEQ ID NO: 80).

The invention provides numerous the antibody EV1019 itself and variations of the EV1019 antibody as summarized in Table B. In certain embodiments, a heavy chain contains one or more amino acid substitutions relative to the wild type heavy chain sequence. In some embodiments, a light chain contains one or more amino acid substitutions relative to the wild type EV1019 light chain sequence. In some embodiments, a heavy chain and a light chain each contain one or more amino acid substitutions.

In some embodiments of the invention, the antibody or antigen-binding fragment thereof comprises the heavy chain, EV1019 (SEQ ID NO: 160), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-wt-IgG1-BI (SEQ ID NO: 161), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-wt-IgG1KO (SEQ ID NO: 162), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105G (SEQ ID NO: 163), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105G-IgG1-BI (SEQ ID NO: 164), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105G-IgG1KO (SEQ ID NO: 165), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105S (SEQ ID NO: 166), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105S-IgG1-BI (SEQ ID NO: 167), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S2'7N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105S-IgG1KO (SEQ ID NO: 168), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105A (SEQ ID NO: 169), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019 S27A-BI2 (SEQ ID NO: 221).

In some embodiments of the invention, the antibody or antigen-binding fragment thereof comprises the heavy chain, EV1019-C105A-IgG1-BI (SEQ ID NO: 170), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105A-IgG1KO (SEQ ID NO: 171), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220)- and EV1019-S27A-BI2 (SEQ ID NO: 221).

In some embodiments of the invention, the antibody or antigen-binding fragment thereof comprises the heavy chain, EV1019-C105Q (SEQ ID NO: 172), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N255-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105Q-IgG1-BI (SEQ ID NO: 173), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105Q-IgG1KO (SEQ ID NO: 174), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105T (SEQ ID NO: 175), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105T-IgG1-BI (SEQ ID NO: 176), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105T-IgG1KO (SEQ ID NO: 177), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105M (SEQ ID NO: 178), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105M-IgG1-BI (SEQ ID NO: 179), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO:

209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105M-IgG1KO (SEQ ID NO: 180), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105L (SEQ ID NO: 181), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105L-IgG1-BI (SEQ ID NO: 182), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105L-IgG1KO (SEQ ID NO: 183), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-IgG2 (SEQ ID NO: 222), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-wt-IgG4 (SEQ ID NO: 223), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-wt-IgG4SP (SEQ ID NO: 224), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S2'7N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105G-IgG2 (SEQ ID NO: 225), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO:

206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105G-IgG4 (SEQ ID NO: 226), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105G-IgG4SP (SEQ ID NO: 227), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105S-IgG2 (SEQ ID NO: 228), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105S-IgG4 (SEQ ID NO: 229), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105S-IgG4SP (SEQ ID NO: 230), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105A-IgG2 (SEQ ID NO: 231), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105A-IgG4 (SEQ ID NO: 232), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-527A-BI2 (SEQ ID NO: 221).

In some embodiments of the invention, the antibody or antigen-binding fragment thereof comprises the heavy chain, EV1019-C105A-IgG4SP (SEQ ID NO: 233), and a light chain selected from the group consisting of: EV1019-wt-original (SEQ ID NO: 202), EV1019-wt-BI (SEQ ID NO:

203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105Q-IgG2 (SEQ ID NO: 234), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105Q-IgG4 (SEQ ID NO: 235), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105Q-IgG4SP (SEQ ID NO: 236), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105T-IgG2 (SEQ ID NO: 237), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S2'7N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105T-IgG4 (SEQ ID NO: 238), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105T-IgG4SP (SEQ ID NO: 239), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105M-IgG2 (SEQ ID NO: 240), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N255-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105M-IgG4 (SEQ ID NO: 241), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105M-IgG4SP (SEQ ID NO: 242), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105L-IgG2 (SEQ ID NO: 243), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105L-IgG4 (SEQ ID NO: 244), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In some embodiments of the invention, the antibody or antigen-binding fragment thereof comprises the heavy chain, EV1019-C105L-IgG4SP (SEQ ID NO: 245), and a light chain selected from the group consisting of: EV1019-wt-original (SEQ ID NO: 202), EV1019-wt-BI (SEQ ID NO: 203), EV1019-wt-BI2 (SEQ ID NO: 204), EV1019-wt-original-constant (SEQ ID NO: 205), EV1019-N25S (SEQ ID NO: 206), EV1019-N25S-BI2 (SEQ ID NO: 207), EV1019-N25G (SEQ ID NO: 208), EV1019-N25G-BI2 (SEQ ID NO: 209), EV1019-N25T (SEQ ID NO: 210), EV1019-N25T-BI2 (SEQ ID NO: 211), EV1019-N25R (SEQ ID NO: 212), EV1019-N25R-BI2 (SEQ ID NO: 213), EV1019-N25Q (SEQ ID NO: 214), EV1019-N25Q-BI2 (SEQ ID NO: 215), EV1019-S27N (SEQ ID NO: 216), EV1019-S27N-BI2 (SEQ ID NO: 217), EV1019-S27G (SEQ ID NO: 218), EV1019-S27G-BI2 (SEQ ID NO: 219), EV1019-S27A (SEQ ID NO: 220) and EV1019-S27A-BI2 (SEQ ID NO: 221).

In addition, a variable region of a heavy chain and a variable region of a light chain may be combined to yield a Fab fragment that binds an antigen. Such combination that retains the same or equivalent antigen-binding affinity is useful for producing various versions of antigen-binding fragment, such as single-chain variable fragment (scFv). An scFv is a fusion of the variable regions of the heavy and light chains of immunoglobulins, linked together with a short (usually serine, glycine) linker, and is well known in the art.

Accordingly, a variable region of EV1018 heavy chain may be combined with a variable region of EV1018 light chain. In some embodiments, the variable region of the heavy chain and/or the light chain may be a variant that contains one or more amino acid alterations as compared to the wild type sequence of the chain. Similarly, a variable region of EV1019 heavy chain may be combined with a variable region of EV1019 light chain. In some embodiments, the variable region of the heavy chain and/or the light chain may be a variant that contains one or more amino acid alterations as compared to the wild type sequence of the chain.

In some embodiments, any one of the following 1018 heavy chain variable regions (e.g., wild type and variants thereof) may be combined with the light chain variable region EV1018-VL-wt-original (SEQ ID NO: 364) to form an antigen-binding fragment that binds hGM-CSF: EV1018-VH (SEQ ID NO: 348), EV1018-VH-wt (SEQ ID NO: 349), EV1018-VH-T97A (SEQ ID NO: 350), EV1018-VH-T97V (SEQ ID NO: 351), EV1018-VH-N95D (SEQ ID NO: 352), EV1018-VH-N95E (SEQ ID NO: 353), EV1018-VH-N95K (SEQ ID NO: 354), EV1018-VH-N95Q (SEQ ID NO: 355), EV1018-VH-N93Q-N95T (SEQ ID NO: 356), EV1018-VH-T97A IgG1-original-constant (SEQ ID NO: 357), EV1018-VH-T97V IgG1-original-constant (SEQ ID NO: 358), EV1018-VH-N95D IgG1-original-constant (SEQ ID NO: 359), EV1018-VH-N95E IgG1-original-constant (SEQ ID NO: 360), EV1018-VH-N95K IgG1-original-constant (SEQ ID NO: 361), EV1018-VH-N95Q IgG1-original-constant (SEQ ID NO: 362), and EV1018-VH-N93Q-N95T IgG1-original-constant (SEQ ID NO: 363).

In some embodiments, any one of the following 1018 heavy chain variable regions (e.g., wild type and variants thereof) may be combined with the light chain variable region, EV1018-VL-wt-BI (SEQ ID NO: 365) to form an antigen-binding fragment that binds hGM-CSF: EV1018-VH (SEQ ID NO: 348), EV1018-VH-wt (SEQ ID NO: 349), EV1018-VH-T97A (SEQ ID NO: 350), EV1018-VH-T97V (SEQ ID NO: 351), EV1018-VH-N95D (SEQ ID NO: 352), EV1018-VH-N95E (SEQ ID NO: 353), EV1018-VH-N95K (SEQ ID NO: 354), EV1018-VH-N95Q (SEQ ID NO: 355), EV1018-VH-N93Q-N95T (SEQ ID NO: 356), EV1018-VH-T97A IgG1-original-constant (SEQ ID NO: 357), EV1018-VH-T97V IgG1-original-constant (SEQ ID NO: 358), EV1018-VH-N95D IgG1-original-constant (SEQ ID NO: 359), EV1018-VH-N95E IgG1-original-constant (SEQ ID NO: 360), EV1018-VH-N95K IgG1-original-constant (SEQ ID NO: 361), EV1018-VH-N95Q IgG1-original-constant (SEQ ID NO: 362), and EV1018-VH-N93Q-N95T IgG1-original-constant (SEQ ID NO: 363).

Likewise, in some embodiments, an antigen-binding fragment of EV1019 comprises the heavy chain variable region, EV1019-VH-wt (SEQ ID NO: 152) and a light chain variable region selected from the group consisting of: EV1019-VL-wt (SEQ ID NO: 184), EV1019-VL-BI (SEQ ID NO: 185), EV1019-VL-N25S (SEQ ID NO: 186), EV1019-VL-BI-N25S (SEQ ID NO: 187), EV1019-VL-N25G (SEQ ID NO: 188), EV1019-VL-BI-N25G (SEQ ID NO: 189), EV1019-VL-N25T (SEQ ID NO: 190), EV1019-VL-BI-N25T (SEQ ID NO: 191), EV1019-VL-N25R (SEQ ID NO: 192), EV1019-VL-BI-N25R (SEQ ID NO: 193), EV1019-VL-N25Q (SEQ ID NO: 194), EV1019-VL-BI-N25Q (SEQ ID NO: 195), EV1019-VL-S27N (SEQ ID NO: 196), EV1019-VL-BI-S27N(SEQ ID NO: 197), EV1019-VL-S27G (SEQ ID NO: 198), EV1019-VL-BI-S27G (SEQ ID NO: 199), EV1019-VL-S27A (SEQ ID NO: 200), EV1019-VL-BI-S27A (SEQ ID NO: 201).

In some embodiments, an antigen-binding fragment of EV1019 comprises the heavy chain variable region, EV1019-VH-C105G (SEQ ID NO: 153) and a light chain variable region selected from the group consisting of: EV1019-VL-wt (SEQ ID NO: 184), EV1019-VL-BI (SEQ ID NO: 185), EV1019-VL-N25S (SEQ ID NO: 186), EV1019-VL-BI-N25S (SEQ ID NO: 187), EV1019-VL-N25G (SEQ ID NO: 188), EV1019-VL-BI-N25G (SEQ ID NO: 189), EV1019-VL-N25T (SEQ ID NO: 190), EV1019-VL-BI-N25T (SEQ ID NO: 191), EV1019-VL-N25R (SEQ ID NO: 192), EV1019-VL-BI-N25R (SEQ ID NO: 193), EV1019-VL-N25Q (SEQ ID NO: 194), EV1019-VL-BI-N25Q (SEQ ID NO: 195), EV1019-VL-S27N (SEQ ID NO: 196), EV1019-VL-BI-S27N(SEQ ID NO: 197), EV1019-VL-S27G (SEQ ID NO: 198), EV1019-VL-BI-S27G (SEQ ID NO: 199), EV1019-VL-S27A (SEQ ID NO: 200), EV1019-VL-BI-S27A (SEQ ID NO: 201).

In some embodiments, an antigen-binding fragment of EV1019 comprises the heavy chain variable region, EV1019-VH-C105S (SEQ ID NO: 154) and a light chain variable region selected from the group consisting of: EV1019-VL-wt (SEQ ID NO: 184), EV1019-VL-BI (SEQ ID NO: 185), EV1019-VL-N25S (SEQ ID NO: 186), EV1019-VL-BI-N25S (SEQ ID NO: 187), EV1019-VL-N25G (SEQ ID NO: 188), EV1019-VL-BI-N25G (SEQ ID NO: 189), EV1019-VL-N25T (SEQ ID NO: 190), EV1019-VL-BI-N25T (SEQ ID NO: 191), EV1019-VL-N25R (SEQ ID NO: 192), EV1019-VL-BI-N25R (SEQ ID NO: 193), EV1019-VL-N25Q (SEQ ID NO: 194), EV1019-VL-BI-N25Q (SEQ ID NO: 195), EV1019-VL-S27N (SEQ ID NO: 196), EV1019-VL-BI-S2'7N(SEQ ID NO: 197), EV1019-VL-S27G (SEQ ID NO: 198), EV1019-VL-BI-S27G (SEQ ID NO: 199), EV1019-VL-S27A (SEQ ID NO: 200), EV1019-VL-BI-S27A (SEQ ID NO: 201).

In some embodiments, an antigen-binding fragment of EV1019 comprises the heavy chain variable region, EV1019-VH-C105A (SEQ ID NO: 155) and a light chain variable region selected from the group consisting of: EV1019-VL-wt (SEQ ID NO: 184), EV1019-VL-BI (SEQ ID NO: 185), EV1019-VL-N25S (SEQ ID NO: 186), EV1019-VL-BI-N25S (SEQ ID NO: 187), EV1019-VL-N25G (SEQ ID NO: 188), EV1019-VL-BI-N25G (SEQ ID NO: 189), EV1019-VL-N25T (SEQ ID NO: 190), EV1019-VL-BI-N25T (SEQ ID NO: 191), EV1019-VL-N25R (SEQ ID NO: 192), EV1019-VL-BI-N25R (SEQ ID NO: 193), EV1019-VL-N25Q (SEQ ID NO: 194), EV1019-VL-BI-N25Q (SEQ ID NO: 195), EV1019-VL-S2'7N (SEQ ID NO: 196), EV1019-VL-BI-S27N(SEQ ID NO: 197), EV1019-VL-S27G (SEQ ID NO: 198), EV1019-VL-BI-S27G (SEQ ID NO: 199), EV1019-VL-S27A (SEQ ID NO: 200), EV1019-VL-BI-S27A (SEQ ID NO: 201).

In some embodiments, an antigen-binding fragment of EV1019 comprises the heavy chain variable region, EV1019-VH-C105T (SEQ ID NO: 156) and a light chain variable region selected from the group consisting of: EV1019-VL-wt (SEQ ID NO: 184), EV1019-VL-BI (SEQ ID NO: 185), EV1019-VL-N25S (SEQ ID NO: 186), EV1019-VL-BI-N25S (SEQ ID NO: 187), EV1019-VL-N25G (SEQ ID NO: 188), EV1019-VL-BI-N25G (SEQ ID NO: 189), EV1019-VL-N25T (SEQ ID NO: 190), EV1019-VL-BI-N25T (SEQ ID NO: 191), EV1019-VL-N25R (SEQ ID NO: 192), EV1019-VL-BI-N25R (SEQ ID NO: 193), EV1019-VL-N25Q (SEQ ID NO: 194), EV1019-VL-BI-N25Q (SEQ ID NO: 195), EV1019-VL-S27N (SEQ ID NO: 196), EV1019-VL-BI-S27N(SEQ ID NO: 197), EV1019-VL-S27G (SEQ ID NO: 198), EV1019-VL-BI-S27G (SEQ ID NO: 199), EV1019-VL-S27A (SEQ ID NO: 200), EV1019-VL-BI-S27A (SEQ ID NO: 201).

In some embodiments, an antigen-binding fragment of EV1019 comprises the heavy chain variable region, EV1019-VH-C105M (SEQ ID NO: 157) and a light chain variable region selected from the group consisting of: EV1019-VL-wt (SEQ ID NO: 184), EV1019-VL-BI (SEQ ID NO: 185), EV1019-VL-N25S (SEQ ID NO: 186), EV1019-VL-BI-N25S (SEQ ID NO: 187), EV1019-VL-N25G (SEQ ID NO: 188), EV1019-VL-BI-N25G (SEQ ID NO: 189), EV1019-VL-N25T (SEQ ID NO: 190), EV1019-VL-BI-N25T (SEQ ID NO: 191), EV1019-VL-N25R (SEQ ID NO: 192), EV1019-VL-BI-N25R (SEQ ID NO: 193), EV1019-VL-N25Q (SEQ ID NO: 194), EV1019-VL-BI-N25Q (SEQ ID NO: 195), EV1019-VL-S27N (SEQ ID NO: 196), EV1019-VL-BI-S27N(SEQ ID NO: 197), EV1019-VL-S27G (SEQ ID NO: 198), EV1019-VL-BI-S27G (SEQ ID NO: 199), EV1019-VL-S27A (SEQ ID NO: 200), EV1019-VL-BI-S27A (SEQ ID NO: 201).

In some embodiments, an antigen-binding fragment of EV1019 comprises the heavy chain variable region, EV1019-VH-C105Q (SEQ ID NO: 158) and a light chain variable region selected from the group consisting of: EV1019-VL-wt (SEQ ID NO: 184), EV1019-VL-BI (SEQ ID NO: 185), EV1019-VL-N25S (SEQ ID NO: 186), EV1019-VL-BI-N25S (SEQ ID NO: 187), EV1019-VL-N25G (SEQ ID NO: 188), EV1019-VL-BI-N25G (SEQ ID NO: 189), EV1019-VL-N25T (SEQ ID NO: 190), EV1019-VL-BI-N25T (SEQ ID NO: 191), EV1019-VL-N25R (SEQ ID NO: 192), EV1019-VL-BI-N25R (SEQ ID NO: 193), EV1019-VL-N25Q (SEQ ID NO: 194), EV1019-VL-BI-N25Q (SEQ ID NO: 195), EV1019-VL-S27N (SEQ ID NO: 196), EV1019-VL-BI-S27N(SEQ ID NO: 197), EV1019-VL-S27G (SEQ ID NO: 198), EV1019-VL-BI-S27G (SEQ ID NO: 199), EV1019-VL-S27A (SEQ ID NO: 200), EV1019-VL-BI-S27A (SEQ ID NO: 201).

In some embodiments, an antigen-binding fragment of EV1019 comprises the heavy chain variable region, EV1019-VH-C105L (SEQ ID NO: 159) and a light chain variable region selected from the group consisting of: EV1019-VL-wt (SEQ ID NO: 184), EV1019-VL-BI (SEQ ID NO: 185), EV1019-VL-N25S (SEQ ID NO: 186), EV1019-VL-BI-N25S (SEQ ID NO: 187), EV1019-VL-N25G (SEQ ID NO: 188), EV1019-VL-BI-N25G (SEQ ID NO: 189), EV1019-VL-N25T (SEQ ID NO: 190), EV1019-VL-BI-N25T (SEQ ID NO: 191), EV1019-VL-N25R (SEQ ID NO: 192), EV1019-VL-BI-N25R (SEQ ID NO: 193), EV1019-VL-N25Q (SEQ ID NO: 194), EV1019-VL-BI-N25Q (SEQ ID NO: 195), EV1019-VL-S2'7N (SEQ ID NO: 196), EV1019-VL-BI-S27N(SEQ ID NO: 197), EV1019-VL-S27G (SEQ ID NO: 198), EV1019-VL-BI-S27G (SEQ ID NO: 199), EV1019-VL-S27A (SEQ ID NO: 200), EV1019-VL-BI-S27A (SEQ ID NO: 201).

Variations within the Invention

The present invention includes full length anti-hGM-CSF antibodies or their antigen binding portions, or portions of anti-hGM-CSF antibodies, when two or more kinds of them are administered at the same time. Therefore, bispecific antibody and multi-specific antibody that recognizes hGM-CSF are also included in the present invention.

The variations of the anti-hGM-CSF monoclonal antibody or their antigen binding portion are explained in the above description, but the described features may be substituted or converted in the technology field without departing from the scope of the invention.

Namely, in the scope of the present invention, the following antibodies or its antigen binding portions are included:

(I) the full length antibody and its antigen binding portion (II) a portion of the antibody, and (III) the recombinant human monoclonal antibody, monoclonal antibody (including chimeric antibody and humanized antibody), or its antigen binding portion capable of specifically binding to hGM-CSF and neutralizing its bioactivity, wherein the recombinant human monoclonal antibody is obtained by any well-known technique, based on amino acid sequences of SEQ ID NOs: 4-9 and 330-335, SEQ ID NO: 364 and 365, and SEQ ID NO: 348-363, SEQ ID NO: 184-201 and SEQ ID NO: 152-159, which represents variable region and CDR.

When a specific antibody or its antigen binding portion produced by the above method is applied based on at least one amino acid sequence selected from the each group consisting of SEQ ID NOs: 4-9, or 330-335 described herein, the antibody or its antigen binding portion is also incorporated in the present invention.

Listing of the Antibody Variants

The Tables provided below provide listings of useful antibody chains and fragments for the EV1018 and EV1019 antibodies, respectively.

TABLE A

List of Heavy Chain and Light Chain Variants and Variable Regions for the EV1018 Antibody.

| EV1018 Heavy Chain Variants | | EV1018 Light Chain Variants | |
|---|---|---|---|
| EV1018 | SEQ ID NO: 10 | EV1018-wt-original | SEQ ID NO: 34 |
| EV1018-wt-IgG1KO | SEQ ID NO: 11 | EV1018-wt-BI | SEQ ID NO: 35 |
| EV1018-T97A-IgG1KO | SEQ ID NO: 12 | EV1018-wt-BI2 (G1) | SEQ ID NO: 36 |
| EV1018-T97V-IgG1KO | SEQ ID NO: 13 | EV1018-wt-original-constant | SEQ ID NO: 37 |
| EV1018-N95D-IgG1KO | SEQ ID NO: 14 | EV1018-VL-wt-original | SEQ ID NO: 364 |
| EV1018-N95E IgG1KO | SEQ ID NO: 15 | EV1018-VL-wt-BI | SEQ ID NO: 365 |
| EV1018-N95K IgG1KO | SEQ ID NO: 16 | | |
| EV1018-N95Q IgG1KO | SEQ ID NO: 17 | | |
| EV1018-N93Q-N95T IgG1KO | SEQ ID NO: 18 | | |
| EV1018-wt IgG1-BI | SEQ ID NO: 19 | | |
| EV1018-T97A IgG1-BI | SEQ ID NO: 20 | | |
| EV1018-T97V IgG1-BI | SEQ ID NO: 21 | | |
| EV1018-N95D IgG1-BI | SEQ ID NO: 22 | | |
| EV1018-N95E IgG1-BI | SEQ ID NO: 23 | | |
| EV1018-N95K IgG1-BI | SEQ ID NO: 24 | | |
| EV1018-N95Q IgG1-BI | SEQ ID NO: 25 | | |
| EV1018-N93Q-N95T IgG1-BI | SEQ ID NO: 26 | | |
| EV1018-T97A IgG1-original-constant | SEQ ID NO: 27 | | |
| EV1018-T97V IgG1-original-constant | SEQ ID NO: 28 | | |
| EV1018-N95D IgG1-original-constant | SEQ ID NO: 29 | | |
| EV1018-N95E IgG1-original-constant | SEQ ID NO: 30 | | |
| EV1018-N95K IgG1-original-constant | SEQ ID NO: 31 | | |
| EV1018-N95Q IgG1-original-constant | SEQ ID NO: 32 | | |

TABLE A-continued

| List of Heavy Chain and Light Chain Variants and Variable Regions for the EV1018 Antibody. | | |
|---|---|---|
| EV1018 Heavy Chain Variants | | EV1018 Light Chain Variants |
| EV1018-N93Q-N95T IgG1-original-constant | SEQ ID NO: 33 | |
| EV1018-wt-IgG1-KO-QVQL | SEQ ID NO: 38 | |
| EV1018-T97A-IgG1-KO-QVQL | SEQ ID NO: 39 | |
| EV1018-T97V-IgG1-KO-QVQL | SEQ ID NO: 40 | |
| EV1018-N95D-IgG1-KO-QVQL | SEQ ID NO: 41 | |
| EV1018-N95E IgG1-KO-QVQL | SEQ ID NO: 42 | |
| EV1018-N95K IgG1-KO-QVQL | SEQ ID NO: 43 | |
| EV1018-N95Q IgG1-KO-QVQL | SEQ ID NO: 44 | |
| EV1018-N93Q-N95T IgG1-KO-QVQL | SEQ ID NO: 45 | |
| EV1018-wt IgG1-QVQL-BI | SEQ ID NO: 46 | |
| EV1018-T97A IgG1-QVQL-BI | SEQ ID NO: 47 | |
| EV1018-T97V IgG1-QVQL-BI | SEQ ID NO: 48 | |
| EV1018-N95D IgG1-QVQL-BI | SEQ ID NO: 49 | |
| EV1018-N95E IgG1-QVQL-BI | SEQ ID NO: 50 | |
| EV1018-N95K IgG1-QVQL-BI | SEQ ID NO: 51 | |
| EV1018-N95Q IgG1-QVQL-BI | SEQ ID NO: 52 | |
| EV1018-N93Q-N95T IgG1-QVQL-BI | SEQ ID NO: 53 | |
| EV1018-IgG2 | SEQ ID NO: 54 | |
| EV1018-wt-IgG2 | SEQ ID NO: 55 | |
| EV1018-T97A-IgG2 | SEQ ID NO: 56 | |
| EV1018-T97V-IgG2 | SEQ ID NO: 57 | |
| EV1018-N95D-IgG2 | SEQ ID NO: 58 | |
| EV1018-N95E-IgG2 | SEQ ID NO: 59 | |
| EV1018-N95K-IgG2 | SEQ ID NO: 60 | |
| EV1018-N95Q-IgG2 | SEQ ID NO: 61 | |
| EV1018-N93Q-N95T-IgG2 | SEQ ID NO: 62 | |
| EV1018-IgG4 | SEQ ID NO: 63 | |
| EV1018-wt-IgG4 | SEQ ID NO: 64 | |
| EV1018-T97A-IgG4 | SEQ ID NO: 65 | |
| EV1018-T97V-IgG4 | SEQ ID NO: 66 | |
| EV1018-N95D-IgG4 | SEQ ID NO: 67 | |
| EV1018-N95E-IgG4 | SEQ ID NO: 68 | |
| EV1018-N95K-IgG4 | SEQ ID NO: 69 | |
| EV1018-N95Q-IgG4 | SEQ ID NO: 70 | |
| EV1018-N93Q-N95T-IgG4 | SEQ ID NO: 71 | |
| EV1018-IgG4-SP | SEQ ID NO: 72 | |
| EV1018-wt-IgG4-SP | SEQ ID NO: 73 | |

TABLE A-continued

| List of Heavy Chain and Light Chain Variants and Variable Regions for the EV1018 Antibody. | | |
|---|---|---|
| EV1018 Heavy Chain Variants | | EV1018 Light Chain Variants |
| EV1018-T97A-IgG4-SP | SEQ ID NO: 74 | |
| EV1018-T97V-IgG4-SP | SEQ ID NO: 75 | |
| EV1018-N95D-IgG4-SP | SEQ ID NO: 76 | |
| EV1018-N95E-IgG4-SP | SEQ ID NO: 77 | |
| EV1018-N95K-IgG4-SP | SEQ ID NO: 78 | |
| EV1018-N95Q-IgG4-SP | SEQ ID NO: 79 | |
| EV1018-N93Q-N95T-IgG4-SP | SEQ ID NO: 80 | |
| EV1018 | SEQ ID NO: 81 | |
| EV1018-wt-IgG1KO | SEQ ID NO: 82 | |
| EV1018-T97A-IgG1KO | SEQ ID NO: 83 | |
| EV1018-T97V-IgG1KO | SEQ ID NO: 84 | |
| EV1018-N95D-IgG1KO | SEQ ID NO: 85 | |
| EV1018-N95E IgG1KO | SEQ ID NO: 86 | |
| EV1018-N95K IgG1KO | SEQ ID NO: 87 | |
| EV1018-N95Q IgG1KO | SEQ ID NO: 88 | |
| EV1018-N93Q-N95T IgG1KO | SEQ ID NO: 89 | |
| EV1018-wt IgG1-BI | SEQ ID NO: 90 | |
| EV1018-T97A IgG1-BI | SEQ ID NO: 91 | |
| EV1018-T97V IgG1-BI | SEQ ID NO: 92 | |
| EV1018-N95D IgG1-BI | SEQ ID NO: 93 | |
| EV1018-N95E IgG1-BI | SEQ ID NO: 94 | |
| EV1018-N95K IgG1-BI | SEQ ID NO: 95 | |
| EV1018-N95Q IgG1-BI | SEQ ID NO: 96 | |
| EV1018-N93Q-N95T IgG1-BI | SEQ ID NO: 97 | |
| EV1018-T97A IgG1-original-constant | SEQ ID NO: 98 | |
| EV1018-T97V IgG1-original-constant | SEQ ID NO: 99 | |
| EV1018-N95D IgG1-original-constant | SEQ ID NO: 100 | |
| EV1018-N95E IgG1-original-constant | SEQ ID NO: 101 | |
| EV1018-N95K IgG1-original-constant | SEQ ID NO: 102 | |
| EV1018-N95Q IgG1-original-constant | SEQ ID NO: 103 | |
| EV1018-N93Q-N95T IgG1-original-constant | SEQ ID NO: 104 | |
| EV1018-wt-IgG1-KO-QVQL | SEQ ID NO: 109 | |
| EV1018-T97A-IgG1-KO-QVQL | SEQ ID NO: 110 | |
| EV1018-T97V-IgG1-KO-QVQL | SEQ ID NO: 111 | |
| EV1018-N95D-IgG1-KO-QVQL | SEQ ID NO: 112 | |
| EV1018-N95E IgG1-KO-QVQL | SEQ ID NO: 113 | |
| EV1018-N95K IgG1-KO-QVQL | SEQ ID NO: 114 | |

TABLE A-continued

| List of Heavy Chain and Light Chain Variants and Variable Regions for the EV1018 Antibody. | | |
|---|---|---|
| EV1018 Heavy Chain Variants | | EV1018 Light Chain Variants |
| EV1018-N95Q IgG1-KO-QVQL | SEQ ID NO: 115 | |
| EV1018-N93Q-N95T IgG1-KO-QVQL | SEQ ID NO: 116 | |
| EV1018-wt IgG1-QVQL-BI | SEQ ID NO: 117 | |
| EV1018-T97A IgG1-QVQL-BI | SEQ ID NO: 118 | |
| EV1018-T97V IgG1-QVQL-BI | SEQ ID NO: 119 | |
| EV1018-N95D IgG1-QVQL-BI | SEQ ID NO: 120 | |
| EV1018-N95E IgG1-QVQL-BI | SEQ ID NO: 121 | |
| EV1018-N95K IgG1-QVQL-BI | SEQ ID NO: 122 | |
| EV1018-N95Q IgG1-QVQL-BI | SEQ ID NO: 123 | |
| EV1018-N93Q-N95T IgG1-QVQL-BI | SEQ ID NO: 124 | |
| EV1018-IgG2 | SEQ ID NO: 125 | |
| EV1018-wt-IgG2 | SEQ ID NO: 126 | |
| EV1018-T97A-IgG2 | SEQ ID NO: 127 | |
| EV1018-T97V-IgG2 | SEQ ID NO: 128 | |
| EV1018-N95D-IgG2 | SEQ ID NO: 129 | |
| EV1018-N95E-IgG2 | SEQ ID NO: 130 | |
| EV1018-N95K-IgG2 | SEQ ID NO: 131 | |
| EV1018-N95Q-IgG2 | SEQ ID NO: 132 | |
| EV1018-N93Q-N95T-IgG2 | SEQ ID NO: 133 | |
| EV1018-IgG4 | SEQ ID NO: 134 | |
| EV1018-wt-IgG4 | SEQ ID NO: 135 | |
| EV1018-T97A-IgG4 | SEQ ID NO: 136 | |
| EV1018-T97V-IgG4 | SEQ ID NO: 137 | |
| EV1018-N95D-IgG4 | SEQ ID NO: 138 | |
| EV1018-N95E-IgG4 | SEQ ID NO: 139 | |
| EV1018-N95K-IgG4 | SEQ ID NO: 140 | |
| EV1018-N95Q-IgG4 | SEQ ID NO: 141 | |
| EV1018-N93Q-N95T-IgG4 | SEQ ID NO: 142 | |
| EV1018-IgG4-SP | SEQ ID NO: 143 | |
| EV1018-wt-IgG4-SP | SEQ ID NO: 144 | |
| EV1018-T97A-IgG4-SP | SEQ ID NO: 145 | |
| EV1018-T97V-IgG4-SP | SEQ ID NO: 146 | |
| EV1018-N95D-IgG4-SP | SEQ ID NO: 147 | |
| EV1018-N95E-IgG4-SP | SEQ ID NO: 148 | |
| EV1018-N95K-IgG4-SP | SEQ ID NO: 149 | |
| EV1018-N95Q-IgG4-SP | SEQ ID NO: 150 | |
| EV1018-N93Q-N95T-IgG4-S | SEQ ID NO: 151 | |

TABLE A-continued

List of Heavy Chain and Light Chain Variants and Variable Regions for the EV1018 Antibody.

| EV1018 Heavy Chain Variants | | EV1018 Light Chain Variants |
|---|---|---|
| EV1018-VH | SEQ ID NO: 348 | |
| EV1018-VH-wt | SEQ ID NO: 349 | |
| EV1018-VH-T97A | SEQ ID NO: 350 | |
| EV1018-VH-T97V | SEQ ID NO: 351 | |
| EV1018-VH-N95D | SEQ ID NO: 352 | |
| EV1018-VH-N95E | SEQ ID NO: 353 | |
| EV1018-VH-N95K | SEQ ID NO: 354 | |
| EV1018-VH-N95Q | SEQ ID NO: 355 | |
| EV1018-VH-N93Q-N95T | SEQ ID NO: 356 | |
| EV1018-VH-T97A IgG1-original-constant | SEQ ID NO: 357 | |
| EV1018-VH-T97V IgG1-original-constant | SEQ ID NO: 358 | |
| EV1018-VH-N95D IgG1-original-constant | SEQ ID NO: 359 | |
| EV1018-VH-N95E IgG1-original-constant | SEQ ID NO: 360 | |
| EV1018-VH-N95K IgG1-original-constant | SEQ ID NO: 361 | |
| EV1018-VH-N95Q IgG1-original-constant | SEQ ID NO: 362 | |
| EV1018-VH-N93Q-N95T IgG1-original-constant | SEQ ID NO: 363 | |

TABLE B

List of Heavy Chain and Light Chain Variants and Variable Regions for the EV1019 Antibody.

| EV1019 Heavy Chain Variants | | EV1019 Light Chain Variants | |
|---|---|---|---|
| EV1019-VH-wt | SEQ ID NO: 152 | EV1019-VL-wt | SEQ ID NO: 184 |
| EV1019-VH-C105G | SEQ ID NO: 153 | EV1019-VL-BI | SEQ ID NO: 185 |
| EV1019-VH-C105S | SEQ ID NO: 154 | EV1019-VL-N25S | SEQ ID NO: 186 |
| EV1019-VH-C105A | SEQ ID NO: 155 | EV1019-VL-BI-N25S | SEQ ID NO: 187 |
| EV1019-VH-C105T | SEQ ID NO: 156 | EV1019-VL-N25G | SEQ ID NO: 188 |
| EV1019-VH-C105M | SEQ ID NO: 157 | EV1019-VL-BI-N25G | SEQ ID NO: 189 |
| EV1019-VH-C105Q | SEQ ID NO: 158 | EV1019-VL-N25T | SEQ ID NO: 190 |
| EV1019-VH-C105L | SEQ ID NO: 159 | EV1019-VL-BI-N25T | SEQ ID NO: 191 |
| EV1019 | SEQ ID NO: 160 | EV1019-VL-N25R | SEQ ID NO: 192 |
| EV1019-wt-IgG1-BI | SEQ ID NO: 161 | EV1019-VL-BI-N25R | SEQ ID NO: 193 |
| EV1019-wt-IgG1KO | SEQ ID NO: 162 | EV1019-VL-N25Q | SEQ ID NO: 194 |
| EV1019-C105G | SEQ ID NO: 163 | EV1019-VL-BI-N25Q | SEQ ID NO: 195 |
| EV1019-C105G-IgG1-BI | SEQ ID NO: 164 | EV1019-VL-S27N | SEQ ID NO: 196 |

TABLE B-continued

List of Heavy Chain and Light Chain Variants and Variable Regions for the EV1019 Antibody.

| EV1019 Heavy Chain Variants | | EV1019 Light Chain Variants | |
|---|---|---|---|
| EV1019-C105G-IgG1KO | SEQ ID NO: 165 | EV1019-VL-BI-S27N | SEQ ID NO: 197 |
| EV1019-C105S | SEQ ID NO: 166 | EV1019-VL-S27G | SEQ ID NO: 198 |
| EV1019-C105S-IgG1-BI | SEQ ID NO: 167 | EV1019-VL-BI-S27G | SEQ ID NO: 199 |
| EV1019-C105S-IgG1KO | SEQ ID NO: 168 | EV1019-VL-S27A | SEQ ID NO: 200 |
| EV1019-C105A | SEQ ID NO: 169 | EV1019-VL-BI-S27A | SEQ ID NO: 201 |
| EV1019-C105A-IgG1-BI | SEQ ID NO: 170 | EV1019-wt-original | SEQ ID NO: 202 |
| EV1019-C105A-IgG1KO | SEQ ID NO: 171 | EV1019-wt-BI | SEQ ID NO: 203 |
| EV1019-C105Q | SEQ ID NO: 172 | EV1019-wt-BI2 | SEQ ID NO: 204 |
| EV1019-C105Q-IgG1-BI | SEQ ID NO: 173 | EV1019-wt-original-constant | SEQ ID NO: 205 |
| EV1019-C105Q-IgG1KO | SEQ ID NO: 174 | EV1019-N25S | SEQ ID NO: 206 |
| EV1019-C105T | SEQ ID NO: 175 | EV1019-N25S-BI2 | SEQ ID NO: 207 |
| EV1019-C105T-IgG1-BI | SEQ ID NO: 176 | EV1019-N25G | SEQ ID NO: 208 |
| EV1019-C105T-IgG1KO | SEQ ID NO: 177 | EV1019-N25G-BI2 | SEQ ID NO: 209 |
| EV1019-C105M | SEQ ID NO: 178 | EV1019-N25T | SEQ ID NO: 210 |
| EV1019-C105M-IgG1-BI | SEQ ID NO: 179 | EV1019-N25T-BI2 | SEQ ID NO: 211 |
| EV1019-C105M-IgG1KO | SEQ ID NO: 180 | EV1019-N25R | SEQ ID NO: 212 |
| EV1019-C105L | SEQ ID NO: 181 | EV1019-N25R-BI2 | SEQ ID NO: 213 |
| EV1019-C105L-IgG1-BI | SEQ ID NO: 182 | EV1019-N25Q | SEQ ID NO: 214 |
| EV1019-C105L-IgG1KO | SEQ ID NO: 183 | EV1019-N25Q-BI2 | SEQ ID NO: 215 |
| EV1019-IgG2 | SEQ ID NO: 222 | EV1019-S27N | SEQ ID NO: 216 |
| EV1019-wt-IgG4 | SEQ ID NO: 223 | EV1019-S27N-BI2 | SEQ ID NO: 217 |
| EV1019-wt-IgG4SP | SEQ ID NO: 224 | EV1019-S27G | SEQ ID NO: 218 |
| EV1019-C105G-IgG2 | SEQ ID NO: 225 | EV1019-S27G-BI2 | SEQ ID NO: 219 |
| EV1019-C105G-IgG4 | SEQ ID NO: 226 | EV1019-S27A | SEQ ID NO: 220 |
| EV1019-C105G-IgG4SP | SEQ ID NO: 227 | EV1019-S27A-BI2 | SEQ ID NO: 221 |
| EV1019-C105S-IgG2 | SEQ ID NO: 228 | EV1019-wt-original | SEQ ID NO: 270 |
| EV1019-C105S-IgG4 | SEQ ID NO: 229 | EV1019-wt-BI | SEQ ID NO: 271 |
| EV1019-C105S-IgG4SP | SEQ ID NO: 230 | EV1019-wt-BI2 | SEQ ID NO: 272 |
| EV1019-C105A-IgG2 | SEQ ID NO: 231 | EV1019-wt-original-constant | SEQ ID NO: 273 |
| EV1019-C105A-IgG4 | SEQ ID NO: 232 | EV1019-N25S | SEQ ID NO: 274 |
| EV1019-C105A-IgG4SP | SEQ ID NO: 233 | EV1019-N25S-BI2 | SEQ ID NO: 275 |
| EV1019-C105Q-IgG2 | SEQ ID NO: 234 | EV1019-N25G | SEQ ID NO: 276 |
| EV1019-C105Q-IgG4 | SEQ ID NO: 235 | EV1019-N25G-BI2 | SEQ ID NO: 277 |
| EV1019-C105Q-IgG4SP | SEQ ID NO: 236 | EV1019-N25T | SEQ ID NO: 278 |
| EV1019-C105T-IgG2 | SEQ ID NO: 237 | EV1019-N25T-BI2 | SEQ ID NO: 279 |
| EV1019-C105T-IgG4 | SEQ ID NO: 238 | EV1019-N25R | SEQ ID NO: 280 |
| EV1019-C105T-IgG4SP | SEQ ID NO: 239 | EV1019-N25R-BI2 | SEQ ID NO: 281 |
| EV1019-C105M-IgG2 | SEQ ID NO: 240 | EV1019-N25Q | SEQ ID NO: 282 |

TABLE B-continued

List of Heavy Chain and Light Chain Variants and Variable Regions for the EV1019 Antibody.

| EV1019 Heavy Chain Variants | | EV1019 Light Chain Variants | |
|---|---|---|---|
| EV1019-C105M-IgG4 | SEQ ID NO: 241 | EV1019-N25Q-BI2 | SEQ ID NO: 283 |
| EV1019-C105M-IgG4SP | SEQ ID NO: 242 | EV1019-S27N | SEQ ID NO: 284 |
| EV1019-C105L-IgG2 | SEQ ID NO: 243 | EV1019-S27N-BI2 | SEQ ID NO: 285 |
| EV1019-C105L-IgG4 | SEQ ID NO: 244 | EV1019-S27G | SEQ ID NO: 286 |
| EV1019-C105L-IgG4SP | SEQ ID NO: 245 | EV1019-S27G-BI2 | SEQ ID NO: 287 |
| EV1019 | SEQ ID NO: 246 | EV1019-S27A | SEQ ID NO: 288 |
| EV1019-wt-IgG1-BI | SEQ ID NO: 247 | EV1019-S27A-BI2 | SEQ ID NO: 289 |
| EV1019-wt-IgG1KO | SEQ ID NO: 248 | | |
| EV1019-C105G | SEQ ID NO: 249 | | |
| EV1019-C105G-IgG1-BI | SEQ ID NO: 250 | | |
| EV1019-C105G-IgG1KO | SEQ ID NO: 251 | | |
| EV1019-C105S | SEQ ID NO: 252 | | |
| EV1019-C105S-IgG1-BI | SEQ ID NO: 253 | | |
| EV1019-C105S-IgG1KO | SEQ ID NO: 254 | | |
| EV1019-C105A | SEQ ID NO: 255 | | |
| EV1019-C105A-IgG1-BI | SEQ ID NO: 256 | | |
| EV1019-C105A-IgG1KO | SEQ ID NO: 257 | | |
| EV1019-C105Q | SEQ ID NO: 258 | | |
| EV1019-C105Q-IgG1-BI | SEQ ID NO: 259 | | |
| EV1019-C105Q-IgG1KO | SEQ ID NO: 260 | | |
| EV1019-C105T | SEQ ID NO: 261 | | |
| EV1019-C105T-IgG1-BI | SEQ ID NO: 262 | | |
| EV1019-C105T-IgG1KO | SEQ ID NO: 263 | | |
| EV1019-C105M | SEQ ID NO: 264 | | |
| EV1019-C105M-IgG1-BI | SEQ ID NO: 265 | | |
| EV1019-C105M-IgG1KO | SEQ ID NO: 266 | | |
| EV1019-C105L | SEQ ID NO: 267 | | |
| EV1019-C105L-IgG1-BI | SEQ ID NO: 278 | | |
| EV1019-C105L-IgG1KO | SEQ ID NO: 269 | | |
| EV1019-IgG2 | SEQ ID NO: 290 | | |
| EV1019-wt-IgG4 | SEQ ID NO: 291 | | |
| EV1019-wt-IgG4SP | SEQ ID NO: 292 | | |
| EV1019-C105G-IgG2 | SEQ ID NO: 293 | | |
| EV1019-C105G-IgG4 | SEQ ID NO: 294 | | |
| EV1019-C105G-IgG4SP | SEQ ID NO: 295 | | |
| EV1019-C105S-IgG2 | SEQ ID NO: 296 | | |
| EV1019-C105S-IgG4 | SEQ ID NO: 297 | | |

TABLE B-continued

List of Heavy Chain and Light Chain Variants and Variable Regions for the EV1019 Antibody.

| EV1019 Heavy Chain Variants | | EV1019 Light Chain Variants |
|---|---|---|
| EV1019-C105S-IgG4SP | SEQ ID NO: 298 | |
| EV1019-C105A-IgG2 | SEQ ID NO: 299 | |
| EV1019-C105A-IgG4 | SEQ ID NO: 300 | |
| EV1019-C105A-IgG4SP | SEQ ID NO: 301 | |
| EV1019-C105Q-IgG2 | SEQ ID NO: 302 | |
| EV1019-C105Q-IgG4 | SEQ ID NO: 303 | |
| EV1019-C105Q-IgG4SP | SEQ ID NO: 304 | |
| EV1019-C105T-IgG2 | SEQ ID NO: 305 | |
| EV1019-C105T-IgG4 | SEQ ID NO: 306 | |
| EV1019-C105T-IgG4SP | SEQ ID NO: 307 | |
| EV1019-C105M-IgG2 | SEQ ID NO: 308 | |
| EV1019-C105M-IgG4 | SEQ ID NO: 309 | |
| EV1019-C105M-IgG4SP | SEQ ID NO: 310 | |
| EV1019-C105L-IgG2 | SEQ ID NO: 311 | |
| EV1019-C105L-IgG4 | SEQ ID NO: 312 | |
| EV1019-C105L-IgG4SP | SEQ ID NO: 313 | |

Various Embodiments of the Present Invention

In the following embodiments of the invention are described in more detail. The description of the embodiments is organized in a manner known from patent claim drafting because it appears to be useful to exemplify in the specification the teachings from which the protection scope conferred by this patent application may be derived.

Item 1. One embodiment is an isolated anti-hGM-CSF monoclonal antibody or antigen-binding fragment thereof, wherein the antibody or antigen-binding fragment thereof recognizes ELYK (SEQ ID NO: 2) and TMMASHYKQH (SEQ ID to NO: 3) in hGM-CSF (SEQ ID NO: 1).

Item 2. Another embodiment is an isolated anti-hGM-CSF monoclonal antibody or antigen-binding fragment thereof, characterized in that said antibody comprises:

(a) a heavy chain comprising a consensus $V_H$-CDR1-containing sequence, a consensus $V_H$-CDR2-containing sequence, and a consensus $V_H$-CDR3-containing sequence, wherein:

- (i) the consensus $V_H$-CDR1-containing sequence is $FTFSX_1X_2MH$ (SEQ ID NO: 314), wherein $X_1$ is Y or H, and $X_2$ is G or A,
- (ii) the consensus $V_H$-CDR2-containing sequence is $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, and
- (iii) the consensus $V_H$-CDR3-containing sequence is $EX_nX_9GX_{10}X_nX_nDX_n$ (SEQ ID NO: 316), wherein each $X_n$ independently is any naturally occurring amino acid, $X_9$ is M or V, and $X_{10}$ is A or G; and (b) a light chain comprising a consensus $V_L$-CDR1-containing sequence, a consensus $V_L$-CDR2-containing sequence, and a consensus $V_L$-CDR3-containing sequence, wherein:

- (i) the consensus $V_L$-CDR1-containing sequence is $X_nGNX_nX_nNIGSX_{11}AVG$ (SEQ ID NO: 317), wherein each $X_T$, independently is any naturally occurring amino acid, and $X_{11}$ is H or Y,
- (ii) the consensus $V_L$-CDR2-containing sequence is $GX_{12}SPX_{13}SG$ (SEQ ID NO: 318), wherein $X_{12}$ is R or K, and $X_{13}$ is A or P, and
- (iii) the consensus $V_L$-CDR3-containing sequence is $STWDSX_{14}LSAVX_{15}$ (SEQ ID NO: 319), wherein $X_{14}$ is R or S, and $X_{15}$ is V or L. In a further embodiment the antibody or the antigen-binding fragment of Item 1 or Item 2 does specifically bind hGM-CSF, preferably with a $K_D$ of less than 450 pM.

Item 3. Another embodiment is an antibody or antigen-binding fragment thereof as disclosed under Item 1 or 2 which in addition to the features provided under Item 1 or 2, binds to human GM-CSF with a $K_D$ of less than 400 pM.

Item 4. Another embodiment is an antibody or antigen-binding fragment thereof as disclosed under Item 3, wherein the $K_D$ is less than 160 pM.

Item 5. Another embodiment is an antibody or antigen-binding fragment thereof as disclosed under any of Items 1-4, wherein the antibody or antigen-binding fragment therein neutralizes hGM-CSF activity, such that the antibody or antigen-binding fragment thereof has an $IC_{50}$ value of less than 100 pM as determined in a TF-1 proliferation assay at ED80.

Item 6. Another embodiment is an antibody or antigen-binding fragment thereof as disclosed under Item 5, wherein the $IC_{50}$ value is less than 40 pM or less than 30 pM or less than 25 pM. Further preferred antibodies or antigen-binding fragment thereof of the invention do have $IC_{50}$ values of less than 20 pM, less than 25 pM, less than 30 pM or less than 40 pM, as determined in a TF-1 proliferation assay at ED80.

Item 7. Another embodiment is an antibody or antigen-binding fragment thereof as disclosed under Item 5, wherein the $IC_{50}$ value is less than 20 pM.

Item 8. Another embodiment is an antibody or antigen-binding fragment thereof as disclosed under any of Items 1-7, wherein the heavy chain is selected from the group consisting of gamma 1 ($\gamma_1$), gamma 2 ($\gamma_2$), gamma 3 ($\gamma_3$), and gamma 4 ($\gamma_4$).

Item 9. Another embodiment is an antibody or antigen-binding fragment thereof as disclosed under any of Items 1-8, wherein the heavy chain has an amino acid sequence selected from the group consisting of SEQ ID NOs: 10-33, 38-80, 160-183, 222-244, and 245.

Item 10. Another embodiment is an antibody or antigen-binding fragment thereof as disclosed under any of Items 1-9, wherein the light chain is a lambda light chain.

Item 11. Another embodiment is an antibody or antigen-binding fragment thereof as disclosed in Item 10, wherein the lambda light chain comprises at least one or both of the following amino acid substitutions: R100G or A153G.

Item 12. Another embodiment is an antibody or antigen-binding fragment thereof as disclosed under any of Items 1-11, wherein the light chain has an amino acid sequence selected from the group consisting of SEQ ID NOs: 34-37, 202-220, and 221.

Item 13. Another embodiment is an antibody or antigen-binding fragment thereof as disclosed under any of Items 1-9, wherein the light chain is a kappa light chain.

Item 14. Another embodiment is an antibody as disclosed under any of Items 1-13, wherein the heavy chain is selected from the group consisting of gamma 1 ($\gamma_1$), gamma 2 ($\gamma_2$), gamma 3 ($\gamma_3$), and gamma 4 ($\gamma_4$), and wherein the light chain is a lambda light chain.

Item 15. Another embodiment is an antibody or antigen-binding fragment thereof as disclosed under any of Items 1-13, wherein the heavy chain comprises one or more amino acid substitutions selected from the group consisting of Q3E, T97A, T97V, N95D, N95E, N95K, N95Q, N93Q/N95T, K144R, L164A, and L165A.

Item 16. Another embodiment is an antibody or antigen-binding fragment thereof as disclosed under any of items 1-15, wherein the $V_H$-CDR1 comprises the amino acid sequence SYGMH (SEQ ID NO: 4) or SHAMH (SEQ ID NO: 333).

Item 17. Another embodiment is an antibody or antigen-binding fragment thereof as disclosed under any of Items 1-16, wherein the $V_H$-CDR2 comprises the amino acid sequence LTYHHGNRKFYADSVRG (SEQ ID NO: 5) or VIWHDGSKKYYADSVKG (SEQ ID NO: 334).

Item 18. Another embodiment is an antibody or antigen-binding fragment thereof as disclosed under any of Items 1-17, wherein the $V_H$-CDR3 comprises the amino acid sequence ESMGAINDN (SEQ ID NO: 6) or EWVGGTCDS (SEQ ID NO: 335).

Item 19. Another embodiment is an antibody or antigen-binding fragment thereof as disclosed under any of Items 1-18, wherein the $V_L$-CDR1 comprises the amino acid sequence IGNNNNIGSHAVG (SEQ ID NO: 7) or SGNSSNIGSYAVG (SEQ ID NO: 330).

Item 20. Another embodiment is an antibody or antigen-binding fragment thereof as disclosed under any of Items 1-19, wherein the $V_L$-CDR2 comprises the amino acid sequence GRSPPS (SEQ ID NO: 8) or GKSPAS (SEQ ID NO: 331).

Item 21. Another embodiment is an antibody or antigen-binding fragment thereof as disclosed under any of Items 1-20, wherein the $V_L$-CDR3 comprises amino acid residues STWDSSLSAVV (SEQ ID NO: 9) or STWDSRLSAVL (SEQ ID NO: 332).

Item 22. Another embodiment is an isolated anti-hGM-CSF monoclonal antibody or antigen-binding fragment thereof, wherein the antibody or antigen-binding fragment thereof comprises 6 different CDRs, wherein sequences of the 6 CDRs are SEQ ID NOs: 4-9. In a further embodiment the antibody or the antigen-binding fragment of Item 22 does specifically bind hGM-CSF, preferably with a $K_D$ of less than 450 pM, preferably 400 pM or 160 pM.

Item 22A. Another embodiment is an isolated anti-hGM-CSF monoclonal antibody or antigen-binding fragment thereof as disclosed under Item 1, in combination with an isolated anti-hGM-CSF monoclonal antibody or antigen-binding fragment thereof as disclosed under any of Items 2-22.

Item 23. Another embodiment is an antibody or antigen-binding fragment thereof as disclosed under Item 22, wherein said antibody comprises (i) a heavy chain or fragment thereof selected from the group consisting of gamma 1 ($\gamma_1$), gamma 2 ($\gamma_2$), gamma 3 ($\gamma_3$), and gamma 4 ($\gamma_4$), and (ii) a light chain that is a kappa light chain.

Item 24. Another embodiment is an antibody or antigen-binding fragment thereof as disclosed under Item 22, wherein said antibody comprises (i) a heavy chain or fragment thereof selected from the group consisting of gamma 1 ($\gamma_1$), gamma 2 ($\gamma_2$), gamma 3 ($\gamma_3$), and gamma 4 ($\gamma_4$), and (ii) a light chain that is a lambda light chain.

Item 25. Another embodiment is an isolated anti-hGM-CSF monoclonal antibody or antigen-binding fragment thereof that specifically binds hGM-CSF, wherein the antibody or antigen-binding fragment thereof comprises 6 different CDRs, wherein sequences of the 6 CDRs are SEQ ID NOs: 330-335.

Item 26. Another embodiment is an antibody or antigen-binding fragment thereof as disclosed under Item 25, wherein said antibody comprises (i) a heavy chain or fragment thereof selected from the group consisting of gamma 1 ($\gamma_1$), gamma 2 ($\gamma_2$), gamma 3 ($\gamma_3$), and gamma 4 ($\gamma_4$), and (ii) a light chain that is a kappa light chain.

Item 27. Another embodiment is an antibody or antigen-binding fragment thereof as disclosed under Item 25, wherein said antibody comprises (i) a heavy chain selected from the group consisting of gamma 1 ($\gamma_1$), gamma 2 ($\gamma_2$), gamma 3 ($\gamma_3$), and gamma 4 ($\gamma_4$), and (ii) a light chain that is a lambda light chain.

Item 28. Another embodiment is an antibody or antigen-binding fragment thereof as disclosed under any of Items 1-27, further comprising a signal sequence.

Item 29. Another embodiment is an antibody or antigen-binding fragment thereof as disclosed under Item 28, wherein the signal sequence is selected from the group consisting of: SEQ ID NOs: 324, 325 and 326.

Item 30. Another embodiment is an isolated anti-hGM-CSF monoclonal antibody or antigen-binding fragment thereof, said antibody comprising a heavy chain having a heavy chain sequence and a light chain having a light chain sequence, wherein the heavy chain sequence is SEQ ID NO: 10 or a variant thereof selected from the group consisting of SEQ ID NOs: 11-33, 38-79, and 80, and wherein the light chain sequence is SEQ ID NO: 34.

Item 31. Another embodiment is an isolated anti-hGM-CSF monoclonal antibody or antigen-binding fragment thereof, said antibody comprising a heavy chain having a heavy chain sequence and a light chain having a light chain sequence, wherein the heavy chain sequence is SEQ ID NO: 10 or a variant thereof selected from the group consisting of SEQ ID NOs: 11-33, 38-79, and 80, and wherein the light chain sequence is SEQ ID NO: 35.

Item 32. Another embodiment is an isolated anti-hGM-CSF monoclonal antibody or antigen-binding fragment thereof, said antibody comprising a heavy chain having a heavy chain sequence and a light chain having a light chain sequence, wherein the heavy chain sequence is SEQ ID NO: 10 or a variant thereof selected from the group consisting of SEQ ID NOs: 11-33, 38-79, and 80, and wherein the light chain sequence is SEQ ID NO: 36.

Item 33. Another embodiment is an isolated anti-hGM-CSF monoclonal antibody or antigen-binding fragment thereof, said antibody comprising a heavy chain having a heavy chain sequence and a light chain having a light chain sequence, wherein the heavy chain sequence is SEQ ID NO: 10 or a variant thereof selected from the group consisting of SEQ ID NOs: 11-33, 38-79, and 80, and wherein the light chain sequence is SEQ ID NO: 37.

Item 34. Another embodiment is an isolated anti-hGM-CSF monoclonal antibody or antigen-binding fragment thereof, said antibody comprising a heavy chain having a heavy chain sequence and a light chain having a light chain sequence, wherein the heavy chain sequence is SEQ ID NO: 160 or a variant thereof selected from the group consisting of SEQ ID NOs: 161-244 and 245, and wherein the light chain sequence is SEQ ID NO: 202 or a variant thereof selected from the group consisting of SEQ ID NOs: 203-220 and 221.

Item 35. Another embodiment is an isolated anti-hGM-CSF monoclonal antibody or antigen-binding fragment thereof, said antibody comprising a heavy chain variable region, wherein the amino acid sequence of the heavy chain variable region is SEQ ID NO: 152 or a variant thereof selected from the group consisting of SEQ ID NOs: 153-158 and 159, and a light chain variable region, wherein the amino acid sequence of the light chain variable region is SEQ ID NO: 184 or a variant thereof selected from the group consisting of SEQ ID NOs: 185-200 and 201.

Item 36. Another embodiment is an antibody or antigen-binding fragment thereof as disclosed under Item 35, wherein the amino acid sequence of the heavy chain variable region is SEQ ID NO: 152.

Item 37. Another embodiment is an antibody or antigen-binding fragment thereof as disclosed under Item 35, wherein the amino acid sequence of the light chain variable region is SEQ ID NO: 184.

Item 38. Another embodiment is an antibody or antigen-binding fragment thereof as disclosed under Item 35, wherein the amino acid sequence of the heavy chain variable region is SEQ ID NO: 152, and wherein the amino acid sequence of the light chain variable region is SEQ ID NO: 184.

Item 39. Another embodiment is an antibody or antigen-binding fragment thereof as disclosed under any of Items 35-38, wherein said antibody belongs to $IgG_1(\lambda)$ class (subclass).

Item 40. Another embodiment is an isolated anti-hGM-CSF monoclonal antibody or antigen-binding fragment thereof, said antibody comprising a heavy chain variable region, wherein the amino acid sequence of the heavy chain variable region is SEQ ID NO: 348 or a variant thereof selected from the group consisting of SEQ ID NOs: 349-362 and 363, and a light chain variable region, wherein the amino acid sequence of the light chain variable region is SEQ ID NO: 364 or SEQ ID NO: 365.

Item 41. Another embodiment is an antibody or antigen-binding fragment thereof as disclosed under Item 40, wherein the amino acid sequence of the heavy chain variable region is SEQ ID NO: 348.

Item 42. Another embodiment is an antibody or antigen-binding fragment thereof as disclosed under Item 40, wherein the amino acid sequence of the light chain variable region is SEQ ID NO: 364.

Item 43. Another embodiment is an antibody or antigen-binding fragment thereof as disclosed under Item 40, wherein the amino acid sequence of the light chain variable region is SEQ ID NO: 365.

Item 44. Another embodiment is an antibody or antigen-binding fragment thereof as disclosed under any of Items 40-43, wherein said antibody belongs to $IgG_1(\lambda)$ class (subclass).

Item 45. Another embodiment is an isolated nucleic acid encoding the anti-hGM-CSF monoclonal antibody or antigen-binding fragment thereof as disclosed under Items 1-44.

Item 46. Another embodiment is a nucleic acid as disclosed under Item 45, wherein the nucleic acid is DNA.

Item 47. Another embodiment is a vector comprising the DNA as disclosed under Item 46.

Item 48. Another embodiment is a host cell comprising the vector as disclosed under Item 47, wherein the vector is an expression vector.

Item 49. Another embodiment is a kit comprising: (a) the antibody or antigen-binding fragment thereof as disclosed under any of Items 1-44; and (b) one or more containers containing the antibody or antigen-binding fragment thereof.

Item 50. Another embodiment is an antibody or antigen-binding fragment thereof as disclosed under any of Items 1-44, for use in medicine.

Item 51. Another embodiment is a composition comprising the antibody or antigen-binding fragment thereof as disclosed under any of items 1-44, and a pharmaceutically acceptable carrier.

Item 52. Another embodiment is a composition as disclosed in Item 51, further comprising a second isolated antibody or antigen-binding fragment thereof that binds hGM-CSF, such that the composition comprises a plurality of said antibodies, a plurality of said antigen-binding fragments, or at least one said antibody and at least one said antigen-binding fragment, each of which binds hGM-CSF.

Item 53. Another embodiment is a composition as disclosed in Item 52, wherein at least one of the antibodies or antigen-binding fragments thereof is a polypeptide having a sequence selected from the group consisting of SEQ ID NOs: 10-80, 152-245, 320-323, 348-364, and 365.

Item 54. Another embodiment is a kit comprising the composition as disclosed under any of Items 51-53, and one or more containers containing the composition.

Item 55. Another embodiment is a kit as disclosed under Item 49 or Item 54, further comprising an instruction.

Item 56. Another embodiment is an antibody or antigen-binding fragment thereof or the composition as disclosed under any of Items 1-44 and 51-54, for the manufacture or preparation of a medicament for the treatment of a disease or disorder associated with over-expression of hGM-CSF in a subject, wherein the antibody or antigen-binding fragment thereof binds hGM-CSF and is capable of neutralizing hGM-CSF activity.

Item 57. Another embodiment is a use as disclosed under Item 56, wherein the disease or disorder is selected from the group consisting of chronic obstructive pulmonary disease (COPD), asthma, cystic fibrosis, interstitial lung disease, rhinitis, arthritis and related arthropathies, psoriasis, myeloid leukemia, and multiple sclerosis.

Item 58. Another embodiment is a use as disclosed under Item 56 or 57, wherein the antibody or antigen-binding fragment is administered to the subject at a dose not exceeding 500 mg.

Item 59. Another embodiment is a use of the antibody or antigen-binding fragment thereof or the composition as disclosed under any of Items 1-44 and 51-53, for to the treatment of a disease or disorder associated with over-expression of hGM-CSF in a subject, wherein the antibody or antigen-binding fragment thereof binds hGM-CSF and is capable of neutralizing hGM-CSF activity.

Item 60. Another embodiment is a use as disclosed under Item 59, wherein the disease or disorder is selected from the group consisting of chronic obstructive pulmonary disease (COPD), asthma, cystic fibrosis, interstitial lung disease, rhinitis, arthritis and related arthropathies, psoriasis, myeloid leukemia, and multiple sclerosis.

Item 61. Another embodiment is a use as disclosed under Item 59 or 60, wherein the antibody or antigen-binding fragment is administered to the subject at a dose not exceeding 500 mg.

Item 62. Another embodiment is an epitope of hGM-CSF in polypeptides as set forth in SEQ ID NOs: 2 and 3, wherein the epitope is recognized by the antibody or antigen-binding fragment thereof as disclosed under Item 22 or 25, and wherein the polypeptide sequences represent a discontinuous segment of hGM-CSF (SEQ ID NO: 1).

Item 63. Another embodiment is an epitope that is a discontinuous segment of human GM-CSF, wherein the epitope comprises amino acid residues 77-80 of human GM-CSF (SEQ ID NO: 1) and amino acid residues 95-104 of human GM-CSF (SEQ ID NO: 1), and is recognized by an anti-hGM-CSF monoclonal antibody or antigen-binding fragment thereof comprising 6 different CDRs as set forth in SEQ ID NOs: 4-9 or SEQ ID NOs: 330-335.

Item 64. Another embodiment is a method for producing an anti-hGM-CSF monoclonal antibody or antigen-binding fragment thereof that binds hGM-CSF, wherein the antibody or antigen-binding fragment thereof comprises at least a consensus $V_H$-CDR1-containing sequence, a consensus $V_H$-CDR2-containing sequence, a consensus $V_H$-CDR3-containing sequence, a consensus $V_L$-CDR1-containing sequence, a consensus $V_L$-CDR2-containing sequence, and a consensus $V_L$-CDR3-containing sequence, in a host cell, the method comprising:

(i) obtaining the host cell comprising at least one DNA sequence encoding at least the consensus $V_H$-CDR1-containing sequence, the consensus $V_H$-CDR2-containing sequence, the consensus $V_H$-CDR3-containing sequence, the consensus $V_L$-CDR1-containing sequence, the consensus $V_L$-CDR2-containing sequence, and the consensus $V_L$-CDR3-containing sequence, wherein:

(a) the consensus $V_H$-CDR1-containing sequence is $FTFSX_1X_2MH$ (SEQ ID NO: 314), wherein $X_1$ is Y or H, and $X_2$ is G or A, (b) the consensus $V_H$-CDR2-containing sequence is $X_3X_4X_5HX_nGX_nX_6KX_7YADSVX_8G$ (SEQ ID NO: 315), wherein each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K, (c) the consensus $V_H$-CDR3-containing sequence is $EX_nX_9GX_{10}X_nX_nDX_n$ (SEQ ID NO: 316), wherein each $X_n$ independently is any naturally occurring amino acid, $X_9$ is M or V, and $X_{10}$ is A or G, (d) the consensus $V_L$-CDR1-containing sequence is $X_nGNX_nX_nNIGSX_{11}AVG$ (SEQ ID NO: 317), wherein each $X_n$ independently is any naturally occurring amino acid, and $X_{11}$ is H or Y, (e) the consensus $V_L$-CDR2-containing sequence is $GX_{12}SPX_{13}SG$ (SEQ ID NO: 318), wherein $X_{12}$ is R or K, and $X_{13}$ is A or P, and (f) the consensus $V_L$-CDR3-containing sequence is $STWDSX_{14}LSAVX_{15}$ (SEQ ID NO: 319), wherein $X_{14}$ is R or S, and $X_{15}$ is V or L; and (ii) culturing the host cell under conditions suitable for expression of said DNA and production of the antibody or antigen binding fragment thereof.

Item 65. Another embodiment is a method as disclosed under Item 64, wherein the at least one DNA encodes a heavy chain or portion thereof and a light chain or portion thereof, wherein the heavy chain or portion thereof has a sequence selected from the group consisting of SEQ ID NOs: 10-33, 38-80, 152-183, 222-245, 348-362, and 363, and wherein the light chain or portion thereof has a sequence selected from the group consisting of SEQ ID NOs: 34-37, 184-221, 364, and 365.

Item 66. Another embodiment is a method as disclosed under Item 64 or 65, further comprising isolating the antibody or antigen-binding fragment thereof.

Item 67. Another embodiment is a method as disclosed under any of Items 64-66, further comprising preparing a composition comprising said antibody or antigen-binding fragment thereof and a pharmaceutically acceptable carrier.

Item 68. Another embodiment is a vector comprising a DNA sequence encoding a $V_H$-CDR1, a $V_H$-CDR2, and a $V_H$-CDR3, wherein:

$V_H$-CDR1 is (SEQ ID NO: 4)
SYGMH
or (SEQ ID NO: 333)
SHAMH, $V_H$-CDR2 is (SEQ ID NO: 5)
LTYHHGNRKFYADSVRG
or (SEQ ID NO: 334)
VIWHDGSKKYYADSVKG,
and $V_H$-CDR3 is (SEQ ID NO: 6)
ESMGAINDN
or (SEQ ID NO: 335)
EWVGGTCDS.

Item 69. Another embodiment is a vector comprising a DNA sequence encoding a $V_L$-CDR1, a $V_L$-CDR2, and a $V_L$-CDR3, wherein:

$V_L$-CDR1 is (SEQ ID NO: 7)
IGNNNNIGSHAVG
or (SEQ ID NO: 330)
SGNSSNIGSYAVG;

$V_L$-CDR2 is

-continued

```
                              (SEQ ID NO: 8)
GRSPPSG
or

                            (SEQ ID NO: 331)
GKSPASG;
and

VL-CDR3 is
                              (SEQ ID NO: 9)
STWDSSLSAVV
or

                            (SEQ ID NO: 332)
STWDSRLSAVL.
```

Item 70. Another embodiment is a method for identifying a molecule that binds the epitope as disclosed under Item 62 or 63, comprising (i) contacting a biological sample or a peptide library with a probe that comprises the epitope;

(ii) isolating a molecule that specifically binds the probe; and (iii) identifying the molecule.

Item 71. Another embodiment is a method as disclosed under Item 70, further comprising (iv) producing the molecule of (iii).

Item 72. Another embodiment is a method as disclosed under Item 70 or 71, wherein the molecule is an anti-hGM-CSF monoclonal antibody or antigen-binding fragment thereof.

Item 73. Another embodiment is a method as disclosed under any of Items 70-72, wherein the probe further comprises a detectable marker.

Item 74. Another embodiment is a method as disclosed under any of Items 70-73, wherein the probe is immobilized.

Item 75. Another embodiment is an anti-hGM-CSF monoclonal antibody or its antigen binding portion capable of binding to hGM-CSF (hGM-CSF) and neutralizing the bioactivity of hGM-CSF (hGM-CSF), characterized in that the anti-hGM-CSF monoclonal antibody or its antigen binding portion has a complementarity-determining region (CDR) represented by one or more amino acid sequences selected from the group consisting of SEQ ID NOs: 4 to 9.

Item 76. Another embodiment is an anti-hGM-CSF monoclonal antibody or its antigen binding portion capable of binding to hGM-CSF and neutralizing the bioactivity of hGM-CSF, characterized in that the anti-hGM-CSF monoclonal antibody or the antigen binding portion has a complementarity-determining region (CDR) represented by one or more amino acid sequences selected from the group consisting of SEQ ID NOs: 330 to 335.

Item 77. Another embodiment is an anti-hGM-CSF monoclonal antibody or its antigen binding portion as disclosed under Item 75 or Item 76, characterized in that the anti-hGM-CSF monoclonal antibody or its antigen binding portion has an amino acid sequence in which one or more amino acids are substituted, deleted, inserted or added in the complementarity-determining region (CDR).

Item 78. Another embodiment is an anti-hGM-CSF monoclonal antibody or its antigen binding portion as disclosed under Item 75 to Item 77, characterized in that the anti-hGM-CSF monoclonal antibody or its antigen binding portion inhibits proliferation of TF-1 cells by about 50% at the concentration of about 14 pM, when the TF-1 cells are proliferated by the induction of hGM-CSF.

Item 79. Another embodiment is an anti-hGM-CSF monoclonal antibody or its antigen binding portion as disclosed under Item 78, characterized in that the anti-hGM-CSF monoclonal antibody or its antigen binding portion inhibits proliferation of peripheral blood dendritic cells.

Item 80. Another embodiment is an anti-hGM-CSF monoclonal antibody or its antigen binding portion as disclosed under Item 78, characterized in that the anti-hGM-CSF monoclonal antibody or its antigen binding portion has a high affinity for hGM-CSF with $K_D$ value of $4\times10^{-10}$ M or lower.

Item 81. Another embodiment is an anti-hGM-CSF monoclonal antibody or its antigen binding portion as disclosed under Item 75 to Item 80, characterized in that the antibody belongs to $IgG_1$ (λ) class (subclass).

Item 82. Another embodiment is an anti-hGM-CSF monoclonal antibody or its antigen binding portion as disclosed under Item 75 to Item 81, characterized in that the anti-hGM-CSF monoclonal antibody is a human monoclonal antibody.

Item 83. Another embodiment is a medicinal composition for a disease caused by hGM-CSF comprising: the anti-hGM-CSF monoclonal antibody or the antigen binding portion as disclosed under Item 75 to Item 82, and a pharmaceutically acceptable carrier.

Item 84. Another embodiment is a medicinal composition as disclosed under Item 83, characterized in that the disease caused by an excessive production of hGM-CSF is any one selected from the group consisting of:

(a) allergic diseases such as asthma, atopy, and pollinosis, (b) graft rejection, graft-versus-host disease (GVHD), and (c) autoimmune diseases such as rheumatoid arthritis.

Item 85. Another embodiment is an isolated deoxyribonucleic acid (DNA) encoding an anti-hGM-CSF monoclonal antibody or its antigen binding portion capable of binding to hGM-CSF and neutralizing the bioactivity of hGM-CSF, characterized in that the isolated DNA encodes an amino acid sequence comprising at least one selected from the group consisting of SEQ ID NOs: 4 to 9.

Item 86. Another embodiment is an isolated DNA encoding an anti-hGM-CSF monoclonal antibody or its antigen binding portion capable of binding to hGM-CSF and neutralizing the bioactivity of hGM-CSF, characterized in that the isolated DNA encodes an amino acid sequence comprising at least one selected from the group consisting of SEQ ID NOs: 330 to 335.

Item 87. Another embodiment is an isolated DNA capable of hybridizing under stringent conditions with the DNA as disclosed under Item 85 or Item 86.

Item 88. Another embodiment is a vector characterized in that the isolated DNA as disclosed under any of Items 85 to 87 are incorporated therein.

Item 89. Another embodiment is a host cell characterized in that the recombinant expression vector as disclosed under Item 88 is introduced therein.

Item 90. Another embodiment is a method for enhancing activity, characterized in that the plural kinds of anti-hGM-CSF monoclonal antibodies or their antigen binding portions specific for a same particular antigen are administered simultaneously.

Item 91. Another embodiment is a method for enhancing activity as disclosed under Item 90, characterized in that the plural kinds of anti-hGM-CSF monoclonal antibodies or their antigen binding portions comprise two or more types of antibodies or their antigen binding portions selected from the following (a) and (b):

(a) a anti-hGM-CSF monoclonal antibody or its antigen binding portion which has a complementarity-determining region (CDR) represented by an amino acid sequence of SEQ ID NOs: 4 to 9, SEQ ID NOs: 330 to 335, SEQ ID NOs: 336 to 341, or SEQ ID NOs: 342 to 347, and which is specific for the hGM-CSF, (b) a anti-hGM-CSF monoclonal antibody or its antigen binding portion of (a) which has an amino acid sequence in which one or more amino acids are substituted, deleted, inserted or added, and which is specific for hGM-CSF.

Item 92. Another embodiment is a method for enhancing activity as disclosed under Item 91, characterized in that the two or more types of antibodies or their antigen binding portions inhibit the proliferation of TF-1 cells by 80% or more at a concentration of about 55 pM each, when the TF-1 cells are proliferated by the induction of hGM-CSF.

Item 93. Another embodiment is a medicinal composition or a veterinary drug composition comprising: plural kinds of the anti-hGM-CSF monoclonal antibodies or their antigen binding portions specific for a same particular antigen, and a pharmaceutically acceptable carrier.

Item 94. Another embodiment is a medicinal composition or the veterinary drug composition as disclosed under Item 93, characterized in that the plural kinds of anti-hGM-CSF monoclonal antibodies or their antigen binding portions comprise two or more types of antibodies or their antigen binding portions selected from the following (a) and (b):

(a) a anti-hGM-CSF monoclonal antibody or its antigen binding portion which has a complementarity-determining region (CDR) represented by an amino acid sequence of SEQ ID NOs: 4 to 9, SEQ ID NOs: 330 to 335, SEQ ID NOs: 336 to 341, or SEQ ID NOs: 342 to 347, and which is specific for the hGM-CSF, (b) a anti-hGM-CSF monoclonal antibody or its antigen binding portion of (a) which has an amino acid sequence in which one or more amino acids are substituted, deleted, inserted or added, and which is specific for hGM-CSF.

Item 95. Another embodiment is a medicinal composition or the veterinary drug composition as disclosed under Item 94, characterized in that the two or more types of antibodies or their antigen binding portions inhibit the proliferation of TF-1 cells by 80% or more at a concentration of about 55 pM each, when the TF-1 cells are proliferated by the induction of hGM-CSF.

Hereinafter, examples of the present invention will be described more specifically, but the examples do not limit the scope of the present invitation.

EXAMPLES

Example 1

Isolation of Cell Clones Producing Fully Human Antibodies Against hGM-CSF (hGM-CSI)

FIG. 1 shows a flow chart of isolation of antibody-producing cell clones. B-lymphocytes were isolated from blood of donors, whose sera had high anti-GM-CSF monoclonal antibody titers, then they were infected with EBV. The proliferated cells upon EBV infection were used as libraries for antibody-producing cells.

The cells of the antibody-producing cell library were dispersed on 96-well plates and cultured for 3 to 4 weeks. The culture supernatant of each well was screened for the presence of anti-hGM-CSF monoclonal antibody. The screening was carried out by ELISA using 96-well plates coated with recombinant hGM-CSF (rhGM-CSF). The cells in wells positive for antibody production were seeded on new 96-well plates and cultured for 3 to 4 weeks, and then the culture supernatant of each well was subjected to the second screening for the presence of anti-hGM-CSF monoclonal antibody. The cells in wells positive for antibody production were subjected to a limiting dilution culture on 96-well plates for 3 to 5 weeks. Thereafter, the culture supernatant of each well was examined for the presence of the antibody, and the antibody-producing cell clones were finally obtained from the wells plated at 1 cell per well.

Example 2

Identification of Isotype and Subclass of Antibodies

We identified the isotype and subclass of the antibodies produced by three antibody-producing cell clones, EV1007, EV1018 and EV1019 (Table 1). The identification was made by ELISA, which was essentially same as that used for the screening of antibody production in culture supernatants, using the culture supernatants as the first antibody and the isotype and subtype-specific antibodies as the second antibody.

Table 1 shows the name of antibodies and their subclasses for newly obtained three anti-hGM-CSF monoclonal antibodies and the monoclonal antibody J158 4C (referred to as EV1003 hereafter), which was reported in International PCT publication WO 07/049,472.

TABLE 1

| Antibody | Subclass |
|---|---|
| EV1007 | $IgG_1$ λ |
| EV1018 | $IgG_1$ λ |
| EV1019 | $IgG_1$ λ |
| EV1003 | $IgG_1$ λ |

Example 3

Cloning of Antibody Genes from the Antibody-Producing Cells

Antibody genes were cloned from the antibody-producing cells. Total RNA was extracted from the antibody-producing cells, and its cDNA was synthesized by using oligo-dT primer and reverse transcriptase.

By using the cDNA as a template, genes encoding human antibodies were amplified by PCR. Primers were designed based on databases of DNA sequences of antibody genes so that the 5' end contained the transcription initiation site and the 3' end contained the translation termination site.

Example 4

Determination of the Amino Acid Sequences of the Antibodies Based on the Nucleotide Sequences The cDNAs of the antibody genes [EV1007, EV1018 and EV1019, each consisting of heavy (H) chain and light (L) chain genes) were cloned into plasmid vectors, and their nucleotide sequences were analyzed by a sequencer (ABI). Their amino acid sequences were determined based on the nucleotide sequences obtained. For the analysis of the complementary determining regions (CDRs) of the antibodies (EV1007, EV1018, EV1019 and EV1003), a method of Kabat was used. The CDR sequences of the four antibodies are indicated by SEQ ID NOs: 4 through 9 and 330 through 347. Specifically, L-chain CDR1, L-chain CDR2, L-chain CDR3, H-chain CDR1, H-chain CDR2, and H-chain CDR3 of EV1018 are set out in SEQ ID NOs: 4 to 9, respectively. L-chain CDR1, L-chain CDR2, L-chain CDR3, H-chain CDR1, H-chain CDR2, and H-chain CDR3 of EV1019 are set out in SEQ ID NOs: 330 to 335, respectively L-chain CDR1, L-chain CDR2, L-chain CDR3, H-chain CDR1, H-chain CDR2, and H-chain CDR3 of EV1003 are in SEQ ID NOs: 336 to 341, respectively. L-chain CDR1, L-chain CDR2, L-chain CDR3, H-chain CDR1, H-chain CDR2, and H-chain CDR3 of EV1007 are in SEQ ID NOs: 342 to 347, respectively.

Example 5

Confirmation of the Antibody Genes Obtained Encoding Anti-hGM-CSF Monoclonal Antibodies The genes encoding the three antibodies (each consisting of H and L chains) were inserted into expression vectors. The plasmids encoding L and H chain genes of each antibody were transiently transfected into 293T cells using Lipofectamine and Plus reagent (Invitrogen) and were tested for transient antibody expression.

Two days after transfection, cell culture supernatants containing the antibodies secreted were collected. Human IgG and anti-GM-CSF monoclonal antibody in the culture supernatants were detected by ELISA to confirm the transient expression of the human antibodies and anti-GM-CSF monoclonal antibodies.

Example 6

Establishment of Stable CHO-Transfectant Cells Expressing Anti-hGM-CSF Monoclonal Antibodies The expression vectors encoding the anti-GM-CSF monoclonal antibodies were transfected into CHO-K1 cells as described above. Two days after transfection, cells were seeded into 96-well plate and cultured in the selection medium containing an appropriate selection marker for about two weeks. The culture supernatant of each well was screened for anti-hGM-CSF monoclonal antibody by ELISA. Single cells in the wells positive for antibody expression were plated into wells of a 96-well plate. Single cell clones grown in the selective medium were screened for the expression of anti-GM-CSF monoclonal antibody and cell clones stably expressing anti-GM-CSF monoclonal antibody were obtained.

Example 7

Purification of Antibodies

CHO cell clones stably expressing anti-GM-CSF monoclonal antibodies were cultured in a serum-free medium. After respective expression period, the culture supernatants were collected and the antibodies were isolated via an affinity chromatography using a HiTrap rProtein A FF pre-packed column (Amersham) according to the manufacturer's instruction. Purified antibodies were confirmed to have a binding activity to hGM-CSF by ELISA and to consist of about 50 kDa H-chain and about 25 kDa L-chain of antibody by SDS-PAGE.

Example 8

Affinity Analyses of Anti-GM-CSF Monoclonal Antibodies

Figure 2:
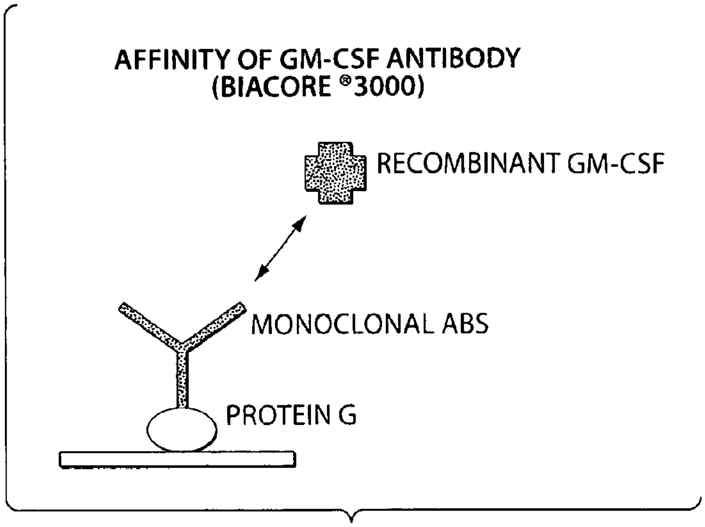
FIG. 2 shows a scheme of affinity analysis of anti-GM-CSF monoclonal antibodies.

To calculate affinity constants for recombinant hGM-CSF binding to anti-hGM-CSF monoclonal antibodies, surface plasmon resonance (SPR) was performed on a Biacore System™ (FIG. 2).

In the method to analyze the interaction between antibodies and antigens, the purified antibodies were captured on a sensor chip via interaction with protein G immobilized to sensor chip surface, and then recombinant antigens were injected to the sensor chip. Purified antibodies were used and recombinant hGM-CSF was used as an antigen.

The equilibrium dissociation constants ($K_D$) for recombinant hGM-CSF derived from yeast (Leukine Berlex) and from *E. coli* (Peprotech) to anti-hGM-CSF monoclonal antibodies are shown in Table 2.

TABLE 2

| | equilibrium dissociation constants ($K_D$ ((M)) | |
|---|---|---|
| Antibody | Leukine | Peprotech |
| EV1007 | $1.2 \times 10^{-9}$ | $9.3 \times 10^{-10}$ |
| EV1018 | $2.3 \times 10^{-10}$ | $1.5 \times 10^{-10}$ |
| EV1019 | $3.6 \times 10^{-10}$ | $1.5 \times 10^{-10}$ |
| EV1003 | $2.3 \times 10^{-10}$ | $9.5 \times 10^{-11}$ |

In this assay, $K_D$ values to yeast GM-CSF (Leukine) were $1.2\times10^{-9}$ M for EV1007, $2.3\times10^{-10}$ M for EV1018, and $3.6\times10^{-10}$ M for EV1019. $K_D$ value for the monoclonal antibody EV1003 which had been generated previously was $2.3\times10^{-10}$ M.

$K_D$ value to *E. coli* (Peprotech) was $9.3\times10^{-10}$M for EV1007, $1.5\times10^{-10}$ M for EV1018, $1.5\times10^{-10}$ M for EV1019, and $9.5\times10^{-11}$ M for EV1003. All four hGM-CSF monoclonal antibodies generated bound to recombinant hGM-CSFs with high affinity.

Example 9

Inhibitory Effect of Anti-GM-CSF Monoclonal Antibodies on Proliferation of Peripheral Blood Dendritic Cells $5\times10^5$ of dendritic cells (DCs) containing plasamacytoid DC and myeloid DC were obtained from $7\times10^7$ of human mononuclear cells using Blood Dendritic Cell Isolation Kit II Human (Miltenyi Biotech).

The DCs obtained were suspended in RPMI 1640 medium (Gibco) supplemented with 10% FCS, rhGM-CSF (1 ng/mL, Peprotech), TNF-α (10 ng/mL) and anti-GM-CSF monoclonal antibodies (1 μg/mL), seeded in 96-well flat-bottom plates at a concentration of $2\times10^4$ cells/well, and incubated for 10 days.

Anti-GM-CSF polyclonal antibody (anti-GM-CSF pAbs, R&D) (1 μg/mL) and human anti-human cytomegalovirus monoclonal antibody (hIgG) (1 μg/mL), which we had generated, were used as controls. The result is shown in FIG. 3.

Figure 3:
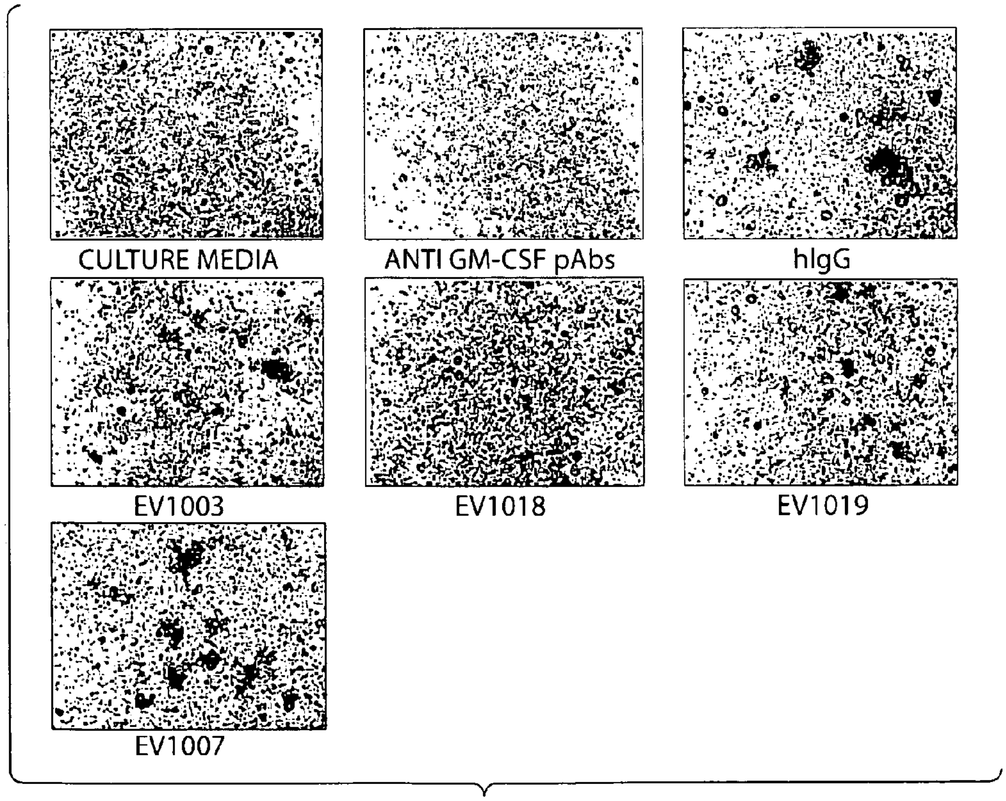
FIG. 3 shows evaluation of inhibitory effect of anti-GM-CSF monoclonal antibodies on proliferation of peripheral blood dendritic cells in the presence of GM-CSF.

As seen in FIG. 3, EV1003, EV1018, and EV1019 inhibited GM-CSF-dependent proliferation of DCs. In contrast, EV1007 showed no inhibition. On the other hand, anti-GM-CSF pAb inhibited GM-CSF-dependant proliferation of DCs, but hIgG did not.

EV1003, EV1018, and EV1019 could block GM-CSF-dependent proliferation of DCs independently.

Example 10

Figure 4:
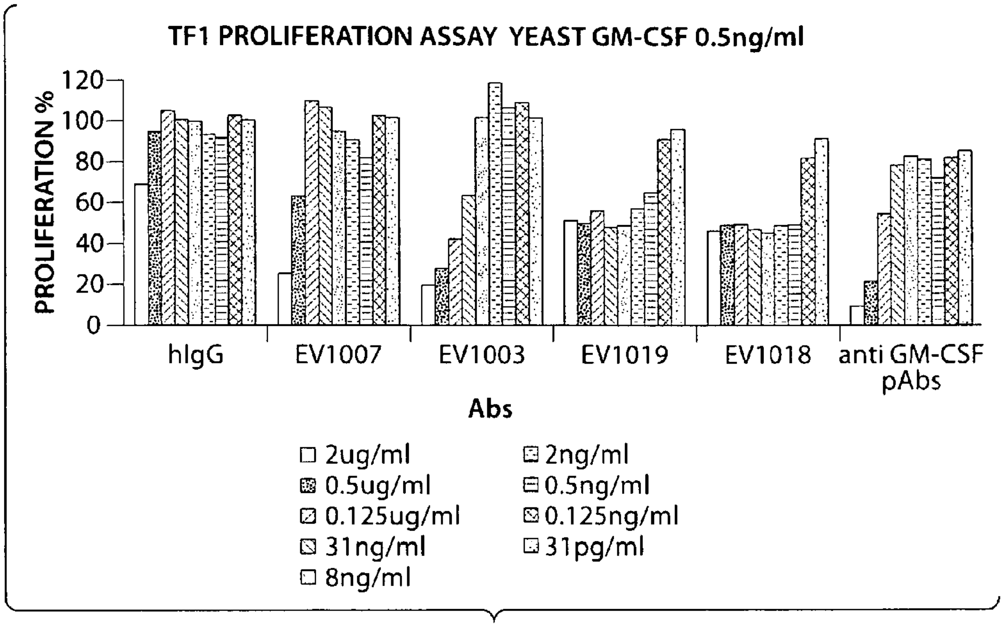
FIG. 4 shows evaluation of inhibitory effect of anti-GM-CSF monoclonal antibodies on the proliferation of TF-1 cells in the presence of yeast hGM-CSF (Leukine).
Figure 5:
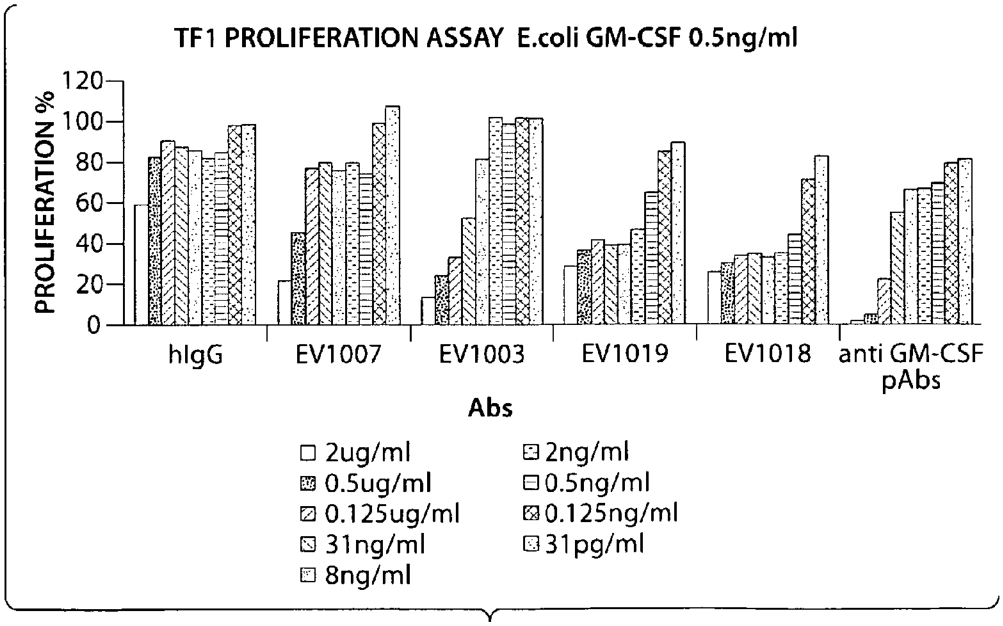
FIG. 5 shows evaluation of inhibitory effect of anti-GM-CSF monoclonal antibodies on the proliferation of TF-1 cells in the presence of *E. coli* hGM-CSF (Peprotech).

Evaluation of Neutralizing Potency of Anti-GM-CSF Monoclonal Antibodies Using TF-1 Cells We tested the neutralizing capacity of the purified anti-hGM-CSF monoclonal antibodies (EV1007, EV1018, and EV1019) and EV1003, which was generated previously using TF-1 cells, which proliferate dependent on the presence of hGM-CSF, as shown in FIGS. 4 and 5.

Purified antibodies were pre-incubated with recombinant hGM-CSF and the mixture was added to the TF-1 cell culture. After 2 days of culture, the proliferative status of the TF-1 cells was determined by a colorimetric assay. Antibody possessing GM-CSF-neutralizing activity could block recombinant GM-CSF activity added, resulting in inhibition of GM-CSF-dependant TF-1 cell growth.

FIGS. 4 and 5 show the inhibitory effects (neutralizing activity) of the antibodies on the proliferation of TF-1 cells stimulated by yeast hGM-CSF (Leukine) and *E. coli* hGM-CSF (Peprotech), respectively.

Each antibody was assessed independently for its inhibitory effect and anti-GM-CSF pAb and hIgG were used as controls as described in Example 9.

The antibodies with four-fold serial dilution at a concentration range from 2 μg/mL to 31 pg/mL were tested. A final concentration of 0.5 ng/mL rhGM-CSF was used for all tests. After 40 h of incubation, TF-1 cell viability was estimated by the color intensity of A450/ref. A495 using a Cell Counting Kit (WST-1 assay, DOJIN).

In the y-axis of FIGS. 4 and 5, TF-1 cell viability with control hIgG at 31 pg/mL was set at 100%, and TF-1 cell viability without rhGM-CSF was set at 0%. Antibodies tested are indicated at the bottom of the figures and their concentrations are indicated at the right side of the figures.

Yeast rhGM-CSF (Leukine) at a concentration of 0.5 ng/mL was used to stimulate the proliferation of TF-1 cells and the results of the neutralizing capacity of each anti-hGM-CSF monoclonal antibody are shown in FIG. 4. While hIgG as a negative control exhibited a non-specific inhibition of cell growth at a high concentration of 2 μg/mL, it showed no inhibition at less than 2 μg/mL of concentration. Anti-hGM-CSF polyclonal antibodies (anti-GM-CSF pAbs) showed cell growth-inhibition dependent on the antibody concentrations at 125 ng/mL or more than 125 ng/mL.

Among the monoclonal antibodies purified, EV1003 inhibited the growth of TF1 cells to the 60% of the positive control at a concentration of 31 ng/mL, and concentration-dependent growth inhibition was observed at 31 ng/mL or more than 31 ng/mL. EV1018 and EV1019 showed about 50% inhibition at concentrations of 0.5 ng/mL or more than 0.5 ng/mL and 2 ng/mL or more than 2 ng/mL, respectively. It was confirmed that EV1018 and EV1019 had extremely high neutralizing activity for hGM-CSF. EV1007 showed cell growth-inhibition clearly at concentrations of 0.5 μg/mL or more than 0.5 μg/mL, indicating that its neutralizing capacity was very low.

*E. coli* rhGM-CSF (Peprotech) at a concentration of 0.5 ng/mL was used to stimulate the proliferation of TF-1 cells and the results of the neutralizing capacity of each anti-hGM-CSF monoclonal antibody are shown in FIG. 5. In this assay, hIgG as a negative control exhibited a non-specific inhibition of cell growth at a high concentration of 2 μg/mL, but it showed no inhibition at less than 2 μg/mL of concentration. Anti-hGM-CSF polyclonal antibodies (anti-GM-CSF pAbs) showed cell growth-inhibition dependent on the antibody concentrations at 31 ng/mL or more than 31 ng/mL.

Among the monoclonal antibodies purified, EV1003 showed clear inhibition of TF1 cell proliferation in a concentration dependent manner at 31 ng/mL or more than 31 ng/mL. EV1018 and EV1019 showed more than 50% of inhibition at concentrations of 0.5 ng/mL or more than 0.5 ng/mL and 2 ng/mL or more than 2 ng/mL, respectively. It was confirmed that neutralizing activities of EV1018 and EV1019 were extremely high.

EV1007 showed cell growth inhibition clearly at a concentration of 0.5 μg/mL or more than 0.5 μg/mL, indicating that its neutralizing capacity was very low compared with EV1018 and EV1019.

Figure 6:
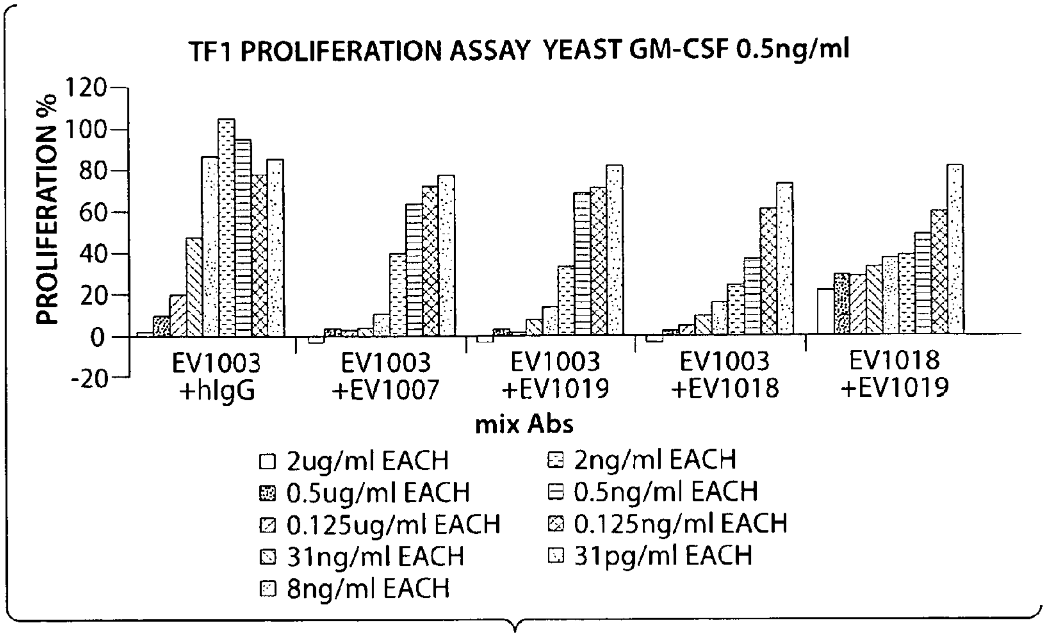
FIG. 6 shows evaluation of inhibitory effect of combined use of two anti-GM-CSF monoclonal antibodies on the proliferation of TF-1 cells in the presence of yeast hGM-CSF (Leukine).
Figure 7:
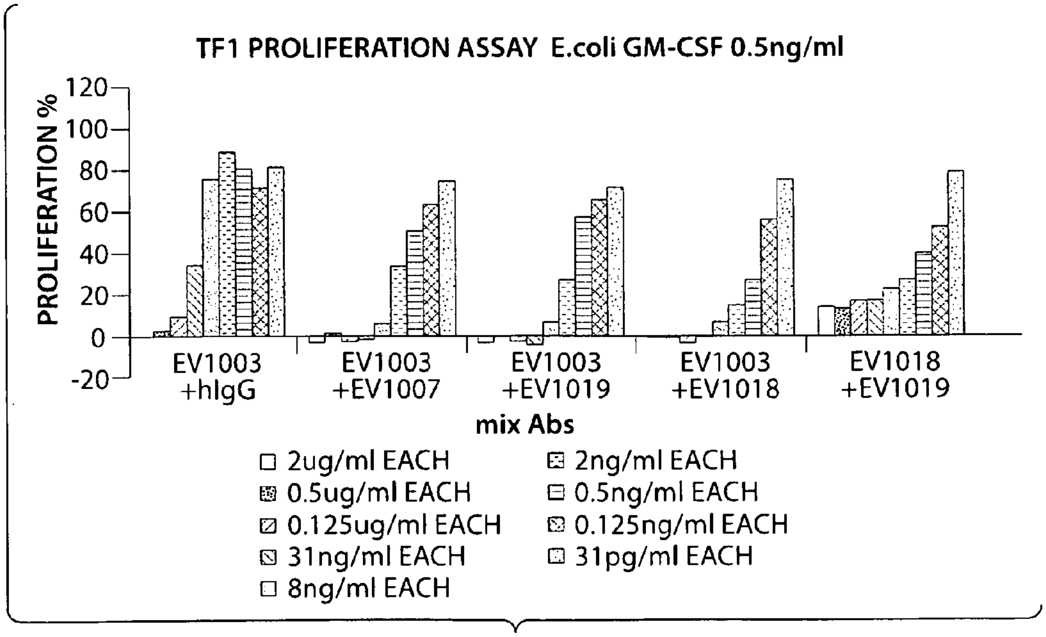
FIG. 7 shows evaluation of inhibitory effect of combined use of two anti-GM-CSF monoclonal antibodies on the proliferation of TF-1 cells in the presence of *E. coli* hGM-CSF (Peprotech).

The neutralizing activity of combination of two antibodies was assessed (FIGS. 6 and 7). Five combinations of mixed antibodies were listed in Table 3.

TABLE 3

| | |
|---|---|
| Mix-1 | EV1003 + hIgG |
| Mix-2 | EV1003 + EV1007 |
| Mix-3 | EV1003 + EV1018 |
| Mix-4 | EV1003 + EV1019 |
| Mix-5 | EV1018 + EV1019 |

Test solutions for each antibody were prepared by serial four-fold dilution at a concentration range from 4 μg/mL to 62 pg/mL, and two antibodies of the same concentration were mixed (final concentration is shown in FIGS. 6 and 7). TF-1 cell viability was estimated by the color intensity of A450/ref. A495 using a Cell Counting Kit (WST-1 assay, DOJIN).

In the y-axis of EEGs. 6 and 7, TF-1 cell viability with control hIgG at 31 pg/mL was set at 100%, and the TF1 cell viability without rhGM-CSF was set at 0% as shown in FIGS. 4 and 5. The results of the TF1 cell viability with control hIgG at 31 pg/mL were shown in FIGS. 4 and 5, but not in FIGS. 6 and 7. The combinations of antibodies mixed were indicated at the bottom of the figures and their concentrations were indicated at the right side of the figures.

Among these combinations, inhibitory effects of Mix-2: EV1003+1007, Mix-3: EV1003+1018, and Mix-4:EV1003+1019 were extremely increased compared with a single use of each antibody. For example, as seen in FIG. 6, Mix-4: EV1003+1019 inhibited the growth of TF1 cells to the 10% of the positive control at an each antibody concentration of 8 ng/mL (about 55 pM).

As shown in FIG. 4, EV1003 alone showed no inhibition of TF1 cell proliferation at a concentration of 8 ng/mL and EV1019 alone showed only 50% of inhibition at a concentration of 8 ng/mL. These results indicated that the combination of two antibodies exhibited extremely high neutralizing activities.

While inhibitory effect of EV1007 in a single use was very low, Mix-2:EV1003+1007 inhibited the growth of TF1 cells to the 10% of the positive control at an each antibody concentration of 8 ng/mL (about 55 pM), as shown in FIGS. 6 and 7.

As shown in FIG. 7, when *E. coli* rhGM-CSF (Peprotech) was used to stimulate the proliferation of TF-1 cells, the cell growth was nearly completely inhibited by Mix-2:EV1003+1007, Mix-3:EV1003+1018, and Mix-4:EV1003+1019 at a each concentration of 31 ng/mL or more than 31 ng/mL. It was confirmed that the combined addition of the antibodies exhibited an extremely strong neutralizing activity.

On the other hand, the inhibitory effect of Mix-5:EV1018+1019 was increased in a concentration dependent manner compared with the antibodies at a single use as shown in FIGS. 4 and 5, however, the effect increased was lower than that of Mix-2 to 4.

In the case of Mix-5:EV1018+1019, which mixture effect was not remarkable, the dose dependence curves (neutralizing effect pattern) of both antibodies at a single use were similar.

As shown in FIGS. 4 and 5, among four antibodies (EV1003, EV1007, EV1018, and EV1019), EV1003 showed the strongest inhibition in a single use at a concentration of 2 μg/ml, but even at this high concentration, about 20% of the cells remained. In contrast, Mix-2, Mix-3, and Mix-4 inhibited the cell growth nearly completely at a concentration range from 31 to 125 ng/mL. It was indicated that these three combinations (Mix-2, Mix-3, and Mix-4) exhibited extremely high neutralizing activities.

Combined use of anti-GM-CSF monoclonal antibody (EV1003) and anti-CMV antibody (hIgG), Mix-1, did not enhance the inhibitory effect of the antibodies compared with their single use.

Among three antibodies obtained in the present invention, two antibodies (EV1018 and EV1019) showed extremely high neutralizing activities in single use and combined use. Among the combinations of the antibodies listed in Table 3, certain combinations exhibited a higher neutralizing activity than an additive effect of both antibodies.

The anti-GM-CSF monoclonal antibodies generated as above or their antigen-binding portions are able to specifically bind to hGM-CSF that cause various diseases, and inactivate, (neutralize) the bioactivities of hGM-CSF. Thus, the antibodies or their antigen-binding portions have a higher neutralizing activity against hGM-CSF than anti-hGM-CSF monoclonal antibodies which have been made so far (presently available). The antibodies or their antigen-binding portions show no immunogenicity and do not induce immune response since they are human monoclonal antibodies.

In addition, a simultaneous combined use of the anti-GM-CSF monoclonal antibodies or their antigen-binding portions exhibits an extremely higher inhibitory effect on cell growth (i.e., neutralizing activity) compared to their single use.

Considering these properties, the anti-hGM-CSF monoclonal antibodies or their antigen-binding portions described in the present invention would be effective at low dose as prophylactic or therapeutic agents for diseases associated with elevated GM-CSF, including but not limited to allergic diseases such as asthma, COPD, cystic fibrosis, intestinal lung disease, rhinitis, atopy, and pollinosis, graft rejection, graft-versus-host disease (GVHD), arthritis and related arthropathies, psoriasis, myeloid leukemia, multiple sclerosis, Alzheimer disease and rheumatoid arthritis.

Example 11

Affinity Measurements of Anti-GM-CSF Monoclonal Antibodies in Biacore hGM-CSE Mouse anti-human Biacore chips (GE Healthcare) are used to immobilize each of the antibodies and soluble commercially available purified GM-CSF (Biomol) is allowed to bind. The hGM-CSF used in these experiments is the same as that used in the bioassays described below. The binding affinities are determined using the Biacore software and results are summarized in Table 4.

TABLE 4

| Antibody | $k_a$ | $k_d$ | $K_D$ |
|---|---|---|---|
| EV1003 | $1.05 \times 10^6 \pm 0.01$ | $2.15 \times 10^{-4} \pm 0.01$ | 203 ± 2 pM |
| EV1019 | $8.13 \times 10^5 \pm 0.19$ | $1.21 \times 10^{-4} \pm 0.01$ | 152 ± 1 pM |
| EV1018 | $1.11 \times 10^6 \pm 0.03$ | $1.44 \times 10^{-4} \pm 0.37$ | 112 ± 6 pM |

EV1018 has a higher binding affinity than EV1019, and a much higher binding affinity than EV1003. All variants of EV1018 have binding affinities equal to that of wild-type EV1018.

Cross-Reactivity with GM-CSF from Other Species (Rhesus, Mouse, Marmoset)

The rhesus GM-CSF sequence is present in the public databases (e.g., GenBank Accession No NP_001028121) and is used to design an expression clone as an Fc fusion protein. Protease cleavage sites are introduced to allow release of untagged rhesus GM-CSF protein. The resulting protein possessed excellent biological activity (see next section) and is recognized by all the anti-GM-CSF monoclonal antibodies (EV1018, EV1019, EV1003) in Western blots (data not shown). Biacore measurements (using the same setup described in 1.1 above) are performed and results are given in Table 5.

TABLE 5

| Rhesus GM-CSF monoclonal anti-GM-CSF monoclonal antibody binding studies | | | |
|---|---|---|---|
| Antibody | $k_a$ | $k_d$ | $K_D$ |
| EV1003 | $5.39 \times 10^5 \pm 0.06$ | $3.56 \times 10^{-4} \pm 0.04$ | 661 ± 14 pM |
| EV1019 Batch 1 | $2.91 \times 10^5 \pm 0.23$ | $2.14 \times 10^{-4} \pm 0.01$ | 739 ± 57 pM |
| EV1019 Batch 2 | $3.04 \times 10^5 \pm 0.13$ | $1.65 \times 10^{-4} \pm 0.17$ | 543 ± 34 pM |
| EV1018 | $5.56 \times 10^5 \pm 0.52$ | $2.11 \times 10^{-4} \pm 0.06$ | 381 ± 16 pM |

In all cases, cross-reactivity with rhesus GM-CSF is excellent (all the anti-GM-CSF monoclonal antibodies recognize rhesus GM-CSF protein with a factor of roughly two to three less well than the hGM-CSF). Therewith, Rhesus monkeys provide an excellent non-human primate model for the development of said disclosed anti-GM-CSF monoclonal antibodies.

Measurements with mouse GM-CSF (PeproTech and Biomol; e.g., GenBank Accession No NP 034099) are performed and the results are summarized in Table 6.

TABLE 6

| Mouse GM-CSF monoclonal anti-GM-CSF monoclonal antibody binding studies | | | |
|---|---|---|---|
| Antibody | $k_a$ | $k_d$ | $K_D$ |
| EV1003 | n.d. | n.d. | n.d. |
| EV1019 | $1.1 \times 10^5 \pm 0.1$ | $6 \times 10^{-3} \pm 2$ | 62 ± 27 nM |
| EV1018 | $1.9 \times 10^5 \pm 0.2$ | $3.4 \times 10^{-2} \pm 1.7$ | 193 ± 60 nM |

In all cases, cross-reactivity with mouse GM-CSF is very poor. This data provide a basis for experiments aiming at the identification of the hGM-CSF epitope the anti-GM-CSF monoclonal antibodies bind, wherein GM-CSF protein hybrids between mouse and human has been established.

A marmoset GM-CSF expression clone (e.g., GenBank Accession No. B0KWQ4 with Methionine at position 53 and Proline at position 109) similar to the rhesus GM-CSF expression clone described above is generated. The purified protein is used for Biacore measurements and the results are summarized in Table 7.

TABLE 7

| Marmoset GM-CSF anti-GM-CSF monoclonal antibody binding studies | | | |
|---|---|---|---|
| Antibody | $k_a$ | $k_d$ | $K_D$ |
| EV1003 | n.d. | n.d. | n.d. |
| EV1019 | $2.1 \times 10^5 \pm 0.1$ | $2.14 \times 10^{-4} \pm 0.01$ | 1.4 ± 0.1 nM |
| EV1018 | $3.64 \times 10^5 \pm 0.01$ | $7.6 \times 10^{-4} \pm 0.3$ | 2.1 ± 0.1 nM |

The cross-reactivity with marmoset GM-CSF is significant. All the anti-GM-CSF monoclonal antibodies recognize marmoset GM-CSF protein with a factor of roughly eighteen to nineteen fold less well than the hGM-CSF. As in the case of the Rhesus monkeys, the marmosets provide an excellent animal model for the development of said disclosed anti-GM-CSF monoclonal antibodies.

Example 12

Biological Activity: Neutralization of GM-CSF Bioactivity

TF-1 Proliferation Assay (Human, Rhesus, Marmoset GM-CSF)

The proliferation of the TF-1 human cell line is dependent on growth factors. This cell line is known in the art as an excellent basis for studies on the biological effect of growth factors.

Here we use recombinant GM-CSF (rGM-CSF) for different species such as (i) recombinant hGM-CSF (rhGM-CSF) of hGM-CSF expressed in *E. coli* (Fa. Biomol #2514) by using standard techniques well known in the art or (ii) recombinant rhesus GM-CSF (rrGM-CSF) of rhesus GM-CSF (e.g., GenBank Accession No. NP_001028121) or (ii) recombinant marmoset GM-CSF (rmGM-CSF) of marmoset GM-CSF (e.g., GenBank Accession No. B0KWQ4 with Methionine at position 53 and Proline at position 109) both expressed in HEK 293 using standard techniques well known in the art.

TF-1 cells are grown in Cell Culture Medium (RPMI 1640 (Cat. 31870 Fa. Gibco), 1× Glutamax 100× (Cat. 35050-038 Fa. Gibco), 1 mM Sodium Pyrovat 100 mM (Cat. 11360-039 Fa. Gibco)), 10 mM Hepes 1M (Cat. 15690-056 Fa. Gibco), 10% FCS (Cat. 10500-064 Fa. Gibco), 2 ng/ml rGM-CSF, (Cat. 200-005L Fa. ReliaTech GmbH). Cells are washed 3 times with PBS and are seeded in 96-well plates (Cat. 167008 Fa. Nunc) in Assay Medium (Cell Culture Medium without rGM-CSF) in a concentration of 1E5 cell/ml. Antibody-solution and GM-CSF-solution are diluted in Dilution Medium (Cell Culture Medium without FCS and without rGM-CSF) and added in a volume of 10 μl, respectively. The cells are incubated for 3 days at 37° C. and 5% $CO_2$ in a humidified chamber. Cell vitality is measured by addition of 20 μl MTS and measuring optical density at 492 nm, according to the instruction of the kit (CellTiter 96 Aqueous One Solution Cell Proliferation Assay, Fa. Promega, Cat. No. G3581). Negative control is TF-1 cells grown in Cell Culture Medium not containing rGM-CSF. Positive control is TF-1 cells grown in Cell Culture Medium containing rGM-CSF at ED80 concentration.

Before testing the neutralizing activity of the antibodies, the ED80 for stimulation of proliferation with human, rhesus and marmoset GM-CSF was determined (Table 8). Human and rhesus GM-CSF are able to stimulate TF-1 proliferation very efficaciously ($ED_{80[human]}$: 1.5 ng/ml; $ED_{80[rhesus]}$: 7 ng/ml), however marmoset GM-CSF is a rather inefficacious stimulator of TF-1 proliferation. Therefore, the human cell line TF-1 is appropriate for testing neutralizing activity against human and rhesus GM-CSF, however is not appropriate for testing GM-CSF derived from marmoset.

TABLE 8

| ED80 for human, rhesus and marmoset GM-CSF in TF-1 proliferation assay. | | |
|---|---|---|
| Species | GM CSF | ED80 |
| human | rhGM-CSF (derived from *E. coli*) | 1.5 ng/ml |
| rhesus | rrGM-CSF (derived from HEK cells) | 7 ng/ml |
| marmoset | rmGM-CSF (derived from HEK cells) | 1 μg/ml |

$IC_{50}$ determination of the antibodies is performed under ED80 concentrations.

Figure 8A:
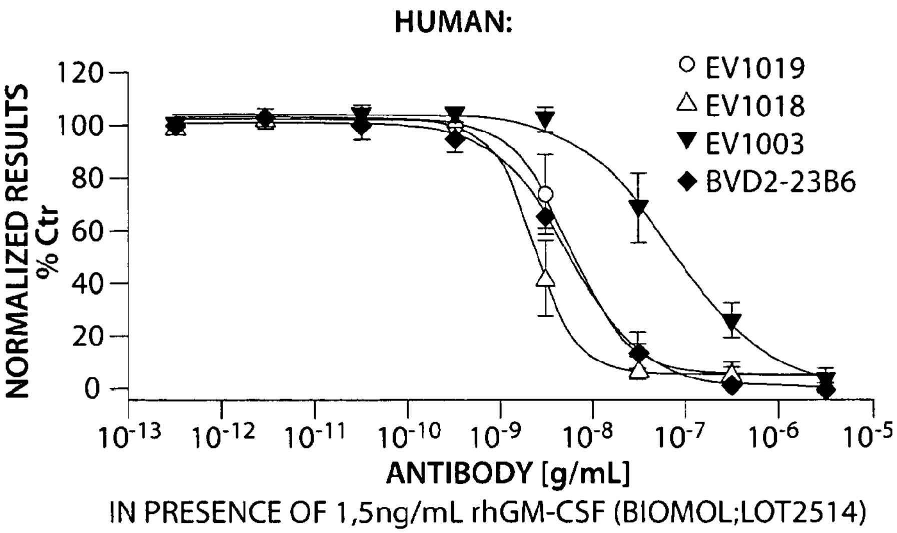
FIG. 8 is two graphs depicting dose-dependent inhibition of: Human GM-CSF (8A) and Rhesus GM-CSF (8B).
Figure 8B:
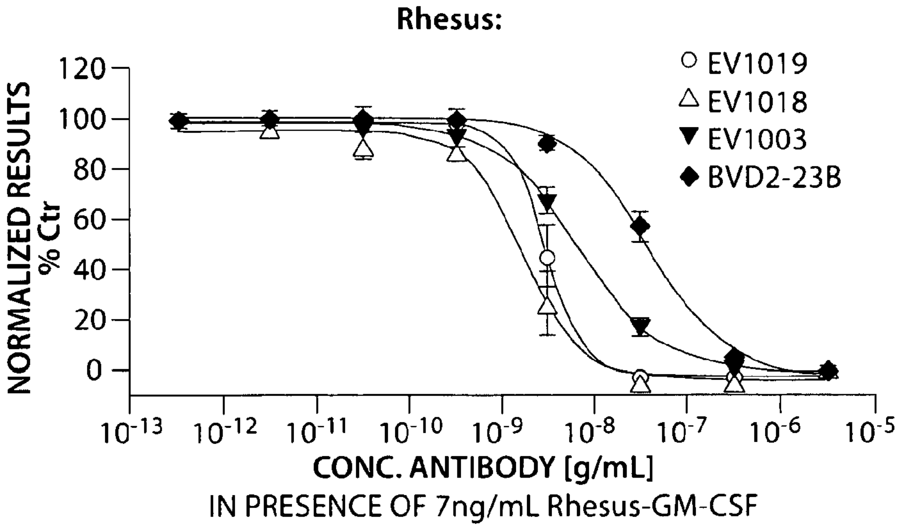

In the y-axis of FIGS. 8A and 8B, TF-1 cell viability of the positive control was set at 100%, and the TF-1 cell viability of the negative control was set at 0%.

An antibody with known neutralising activity, commercially available rat anti-hGM-CSF IgG2a antibody is also used (BVD2-23B6, Fa. BD Pharmingen #554501) (Table 9). Isotype control antibody rat IgG2a (R35-95, Fa. BD #554687) showed no inhibition of cell proliferation (data not shown).

EV1018 and EV1019 have an excellent neutralising activity of human recombinant GM-CSF. EV1018 exceeds the neutralizing activity of BVD2-23B6.

The heavy chain of EV1018 naturally contains an N-glycosylation site within framework 3. This is shown in, for example, SEQ ID NO: 10, corresponding to residues 95-97. Therefore, variants of the EV1018 heavy chain were generated and examined for their neutralizing activity. As provided in Table 9, the result indicates that the bioactivity of EV1018 is maintained following removal of the N-linked glycosylation site in framework 3 of the heavy chain. Table 9 shows IC50 values for two of the glycosylation site sequence variants (EV1018 variant 1 and 2), designated as N95K and T97A, respectively, as compared to WT EV1018 heavy chain containing the N-glycosylation site. The IC50 values for each of the purified IgGs were determined in the TF-1 assay essentially as described. Experiments with further EV1018 variants yielded similar results comparable to those of EV1018.

TABLE 9

| Comparison of IC50 in TF-1 proliferation assay | | |
|---|---|---|
| Antibody | IC50 against hGM-CSF | IC50 against rhesus GM-CSF |
| EV1018 | 2.3 ng/ml | 1.7 ng/ml |
| light chain SEQ ID NO: 34 | 15 pM | 11 pM |
| heavy chain SEQ ID NO: 10 | | |
| EV1019 | 5.7 ng/ml | 2.8 ng/ml |
| light chain SEQ ID NO: 202 | 38 pM | 19 pM |
| heavy chain SEQ ID NO: 160 | | |
| EV1003 | 71.1 ng/ml | 6.6 ng/ml |
| light chain SEQ ID NO: 321 | 474 pM | 44 pM |
| heavy chain SEQ ID NO: 320 | | |
| BVD2-23B6 | 5.3 ng/ml | 38 ng/ml |
| | 35 pM | 253 pM |
| EV1018 variant 1light chain SEQ ID NO: 35 | 32 pM | |
| heavy chain SEQ ID NO: 11 | | |
| EV1018 variant 2 | 33.3 pM | |
| light chain SEQ ID NO: 35 | | |
| heavy chain SEQ ID NO: 16 | | |

Results are given in ng/ml and in pM (assuming a molecular weight of 150 kDa for the antibodies).

In experiments using recombinant rhesus GM-CSF monoclonal antibodies EV1018, EV1019 and EV1003 have a much higher neutralising activity than BVD2-23B6 derived from rat. However, in both types of experiments EV1018 is significantly superior over all antibodies tested. All variants of EV1018 do equally neutralise activity of wild-type EV1018.

In the experiment set up which gave results given in Table 9, the use of the commercially available rat-anti-human-GM-CSF IgG2a BVD2-21C11 (Fa. BD, #554503) is not possible, as under the given ED80 concentrations, i.e., a dose of 1.5 ng/ml rGM-CSF, no reliable results can be obtained. For measuring antibody 21C11, lower rGM-CSF doses are needed as given in Table 10 below.

Comparison of efficacy of antibodies in different laboratories is not possible by comparing simply IC50 values, because IC50 values are strongly dependent on assay conditions, like for example the amount of used stimulus. A much more reliable comparison is possible by comparing the ratio of e.g., IC50 values, obtained in an TF-1 assay as described above but with different rGM-CSF doses as indicated, between a standard antibody and the antibody of interest. For example, WO2006/122797 (Table 8 pages 56 and 57) disclosed its best antibody to be 35-times better than the commercial available antibody rat-anti-human-GM-CSF, clone BVD2-21C11. The ratio between IC50s between commercial available anti-human-GM-CSF monoclonal antibody, clone BVD2-21C11 and EV1018 is 413. Therefore, based on comparison to a commercial standard, the neutralising activity of EV1018 is about tenfold higher as given in Table 10. This is surprising as WO2006/122797 teaches those skilled in the art that the neutralising activity of an anti-GM-CSF monoclonal antibody strongly correlates with its binding affinity to GM-CSF (WO2006/122797, improved binding affinity shown on table 4 on page 50 correlates with accordingly improved neutralising potency shown on tables 6 and 7 on pages 52-54).

Comparing the binding affinity of MOR04357 (WO2006/122797, table 4, page 50: binding affinity is 7 pM for MOR04357-Fab) with the binding affinity of EV1018 we realize that EV1018 binds about 16 times less to GM-CSF than MOR04357. However, the neutralising activity of EV1018 is 10 times higher, compared with MOR04357, indicating that the neutralising activity is not necessarily correlated with the binding affinity to GM-CSF.

TABLE 10

Relative neutralization activities in TF-1 assay of EV1018 and a prior art antibody.

| | | TF-1 assay hGM-CSF (*E. coli*) [pM] | Assay condition GM-CSF final concentration | Ratio: Reference antibody to antibody of interest |
|---|---|---|---|---|
| 1 | Reference ab BVD2-21C11 | 1668 | 0.25 ng/ml | |
| 2 | MOR04357(IgG1) | 48 | 0.25 ng/ml | 35 |
| 3 | Reference ab BVD2-21C11 (Fa. BD, #554503) | 8260 | 1.0 ng/ml | |
| 4 | EV1018 | 20 | 1.0 ng/ml | 413 |

Line 1 and 2: data from WO2006/122797, table 8 pages 56 and 57, line 3 and 4: own data.

IL-8 Secretion Assay in U937 Cells (Human and Rhesus GM-CSF)

IL-8 is a proinflammatory cytokine. It is a crucial factor for neutrophil inflammation and is involved in most inflammatory reactions. Target cells of GM-CSF activity are cells of the myeloid cell linage. The premonocytic cell line U937 is of myeloid origin and secrets the proinflammatory cytokine IL-8 upon stimulation with GM-CSF.

U937 (ATCC: CRL-1593.2) are grown in Cell culture medium (RPMI 1640 (Cat. 31870 Fa. Gibco), 1× Glutamax 100× (Cat. 35050-038 Fa. Gibco), 10% FCS (Cat. 10500-064 Fa. Gibco), 1% PenStrep). 100 μl cell suspension at 1E5 cells/ml are seeded and 10 μl of antibody solution and 10 μl of GM-CSF solution are added. Cells are incubated for 24 hours at 37° C. and 5% $CO_2$ in a humidified chamber. IL-8 cytokine levels are determined using the OptEIA Human IL-8 Elisa Set (Fa. BD Bioscience, Cat. No. 555244).

Negative control is U937 cells grown in cell culture medium without adding antibody and without adding GM-CSF, and positive control is U937 cells grown in cell culture medium containing rGM-CSF at ED80 without addition of antibody solution. ED80 concentration for human and rhesus GM-CSF was determined (Table 9) and this concentration is used to determine IC50s for the different anti-GM-CSF monoclonal antibodies (Table 11).

TABLE 11

Determination of ED80 in IL-8 secretion in U937

| GM-CSF | ED80 |
|---|---|
| Human (derived from *E. coli*, Fa. Biomol #2514) | 1.2 ng/ml |
| Rhesus (derived from HEK cells, in-house) | 5.0 ng/ml |

TABLE 12

Comparison of IC50 in U937 IL-8 secretion assay.

| Antibody | IC50 against hGM-CSF | IC50 against rhesus GM-CSF |
|---|---|---|
| EV1018 | 0.9 ng/ml | 0.8 ng/ml |
| | 6 pM | 5.6 pM |
| EV1019 | 4.7 ng/ml | 2.4 ng/ml |
| | 31.3 pM | 16 pM |
| EV1003 | 14.6 ng/ml | 1.7 ng/ml |
| | 97.3 pM | 11.5 pM |
| BVD2-23B6 | 3.5 ng/ml | 45 ng/ml |
| | 23.3 pM | 300 pM |

Results are given in ng/ml and in pM (assuming a molecular weight of 150 kDa for the antibodies).

In this cellular assay, all three antibodies neutralised very efficiently human GM-CSF, as well rhesus GM-CSF. EV1018 has a higher neutralising activity than EV1019, and a much higher neutralizing capacity than EV1003. All variants of EV1018 exhibit neutralising activity equal to that of wild-type EV1018.

Example 13

Induction of Surface CD11b/Mac1

Granulocytes are a subpopulation of cells of the myeloid lineage and are target cells of GM-CSF biological activity. Beside other effector functions, GM-CSF induces the adhesion molecule CD11b/Mac1 on the surface of granulocytes. Induction of CD11b/Mac1 on the surface of cells of the myeloid cell linage is an essential step of cell migration from the peripheral blood into inflamed tissue. Patients with chronic inflammatory airway disease like COPD and asthma have elevated numbers of granulocytes in sputum and bronchoalveolar lavage fluid. Therefore, the efficacy of anti-GM-CSF-antibodies was tested on GM-CSF-mediated induction of the adhesion marker CD11b/Mac1 on primary hGranulocytes.

80 μl of coagulation inhibited peripheral blood from healthy donors is incubated for 15 min at 37° C. with anti-GM-CSF monoclonal antibodies or isotype antibody (human IgG, #1-2511; Fa. Sigma-Aldrich) (positive control) preincubated for 20 min with rhGM-CSF (30 pM final concentration) (Fa Biomol, #2514). Negative control is incubation of the coagulation inhibited blood for 15 min at 37° C. with isotype antibody preincubated with PBS, 01% BSA for 20 min.

For quantification of CD11b/Mac1 expression, anti-CD11b antibody labeled with phycoerythrin (Fa: Pharmingen; Cat: 333142) is used according to instructions of the supplier. In brief, 20 μl of the anti-CD11b antibody solution is added to the cells, incubated for 30 min at room temperature in the dark. Erythrocytes (red blood cells) are lysed by adding 2 ml of Lysis solution (Fa: BD; Cat 349202) and incubated for additional 10 min at room temperature in the dark. After two washing steps with PBS, 0.1% BSA, white blood cells are suspended in 500 μl Cellfix (Fa: BD; Cat 340181). For analysis, a LSRII flow cytometer and DIVA6.1.1 software for analysing FACS data (both Fa. BD) is used. The granulocyte cell population is gated on a dotplot using forward and sideward scatter and set to 100%. 30 pM of rhGM-CSF is used to stimulate CD11b/Mac1 on the surface of granulocytes. 67 pM of EV1018 is sufficient to completely block GM-CSF induced CD11b/Mac1.

These data indicate that EV1018 efficaciously neutralises GM-CSF biological activity in a context highly significant for inflammatory processes involving increased numbers of granulocytes, like COPD and asthma.

Example 14

Pulmonary Inflammation after Cigarette Smoke Exposure in C57BL/6J Mice

Cigarette smoke is the most crucial factor for developing COPD. Long-term cigarette smoke exposure to animal species like rats and mice causes many pathophysiologically relevant anatomic lesions comparable to the human disease (Fujita and Nakanishi 2007). One important parameter of COPD is chronic bronchitis including increased numbers of neutrophils and macrophages in the lung. To prove that GM-CSF plays a crucial role for smoke-induced cell influx into the lung, anti-GM-CSF monoclonal antibodies were used in a long-term cigarette smoke model in mice.

Mice (strain C57BL/6J, 18-23 g) were exposed to cigarette smoke for 4 days. Mice were exposed to 6 cigarettes on day 1 and 2, to 8 cigarettes on day 3, and to 10 cigarettes on day 4. Exposure of each cigarette lasted for 16 min followed by a 8 min exposure with fresh air. Every second cigarette an additional break of 24 min with exposure to fresh air was conducted. Mice without exposure to cigarette smoke served as a negative control.

Rat anti-mouse GM-CSF IgG2a, 300 μg (clone MPI-22E9, Fa. eBioSciences, #16-7331) or appropriate isotype antibody, 300 μg (rat IgG2a, Fa. eBioSciences, #16-4321) or vehicle 300 μl (PBS, 10 mM NaCl) were administered intraperitoneal (i.p.) 2 hours before smoking protocol at day 1 and at day 3. 18 h after the last exposure the animals were euthanized and the lungs were lavaged with 2×0.8 ml Hanks solution with EDTA. Broncho-alveolar lavage fluid (BALF) was separated by centrifugation into cellular pellet and supernatant. Myeloperoxidase (MPO) activity in the pellet was determined as a parameter for influx of myeloid cells. 500 ml of the lavage fluid samples were spun down at 485×g, 4° C. for 10 min. The pellet was resuspended in 200 ml hexadecyl-trimethyl-ammonium bromide (HTAB) 0.5%. 50 ml of the suspensions were transferred to a 96-well microtiter plate. 250 μl of substrate solution (50 mM $KH_2PO_4$, 5 mM $Na_2HPO_4$, 0.2 mg/ml o-dianisidin dihydrochloride, 0.2 μl/ml $H_2O_2$) was added to each well to start the enzymatic reaction. Extinction at 450 nm was determined for 90 sec. Myeloperoxidase (MPO) activity was calculated during the steady state of the enzymatic reaction. Activity is given as milli-activity units per min (mAU/min).

The cytokines MCP-1 and MIP-1α were determined in the BALF supernatants by multiple analyte detection on a flow cytometer (LSR II, Becton Dickinson). The assay was performed according to instructions from Bender MedSystems (Flow Cytomix). In brief, 25 μl of BALF supernatant were mixed with 25 μl 1× Assay Buffer (Basic Kit BMS8440FF), 25 μl Bead Mixture (mixture of MCP-1 and MIP-1α Simplex Kits, BMS86005FF, BMS86013FF) and 50 μl Biotin-Conjugate Mixture (included in Simplex Kits) and were incubated for 2 hours at room temperature on a microplate shaker at 500 rpm. After 2 times washing with Assay Buffer, beads were resolved in 100 μl Assay Buffer and 50 ml Streptavidin-PE-Solution (included in Basic Kit) were added. Beads were incubated for 1 hour at room temperature on a microplate shaker at 500 rpm. Beads were washed with Assay Buffer two times. Beads were resolved in 500 μl Assay Buffer and were analysed by flow cytometry using FlowCytomix Pro 2.2 Software provided by Bender MedSystems. For quantification a serial dilution of a standard (included in Simplex Kits) was prepared according to the instructions of the supplier (Bender MedSystems). Cytokine concentrations were determined based on the standards.

Figure 9A:
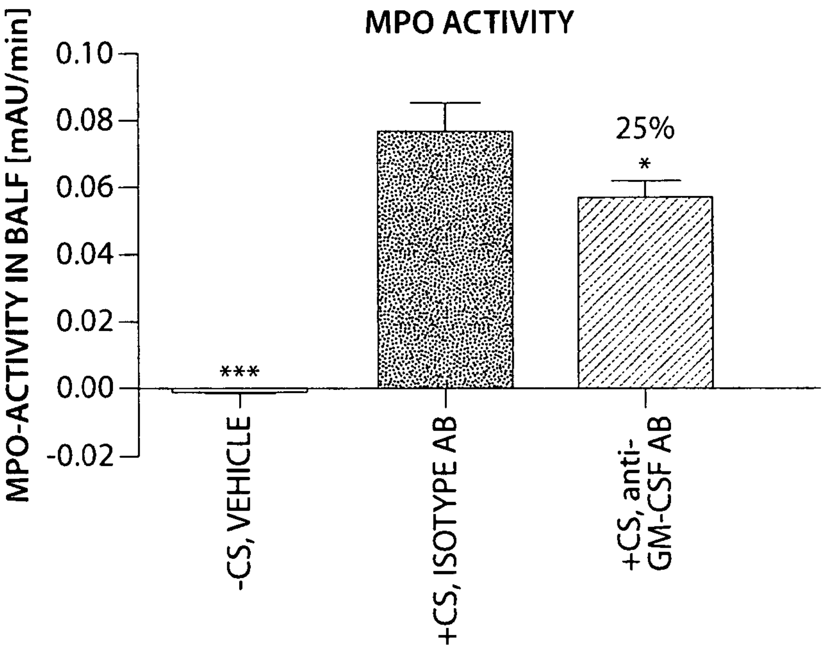
FIG. 9A is a bar graph depicting myeloperoxidase (MPO) activity measured in pellet of broncho-alveolar fluid (BALF) from mice exposed to cigarette smoke. −CS: Mice treated with vehicle (300 μl vehicle i.p. at day 1 and 3, no exposure to cigarette smoke. +CS, isotype AB: Mice treated with 300 μl of isotype antibody i.p. at day 1 and 3, exposure to cigarette smoke. +CS, anti-GM-CSF AB: Mice treated with 300 μl anti-GM-CSF antibody i.p. at day 1 and 3, exposure to cigarette smoke. n=10 per group, mean±SEM, $*p<0.05$, $***p<0.001$.

Upon pretreatment of the mice with anti-GM-CSF antibody, MPO activity was reduced about 25% (FIG. 9A). Consistent with this result, the cytokines MCP-1 and MIP-1α were reduced about 18% and 23%, respectively (FIG. 9B).

Figure 9B:
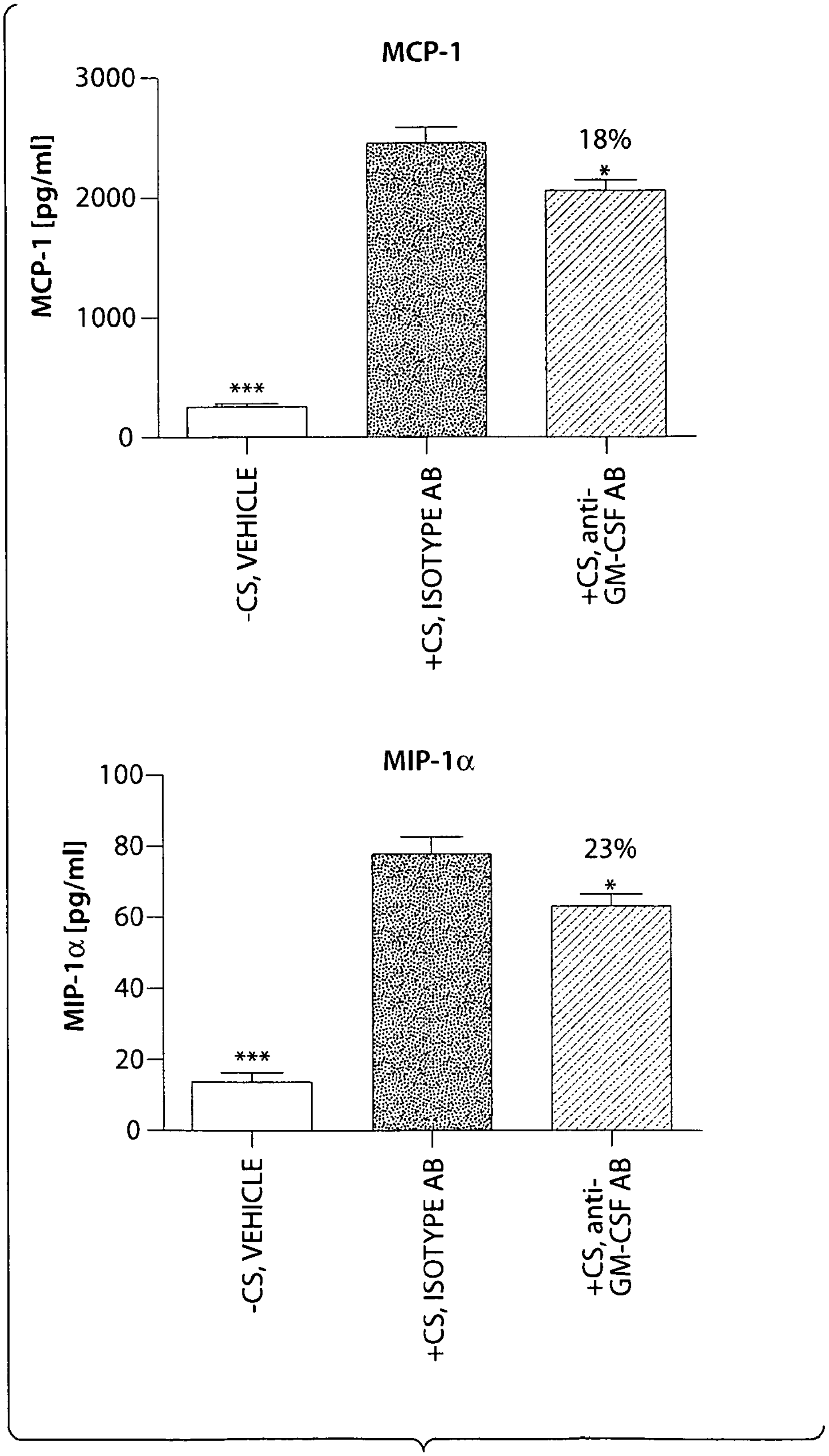
FIG. 9B is a pair of bar graphs depicting cytokine determination in BALF supernatants. Left side: Determination of MCP-1 levels. Right side: Determination of MIP-1α levels. −CS: Mice treated with vehicle (300 μl vehicle i.p. at day 1 and 3), no exposure to cigarette smoke. +CS, isotype AB: Mice treated with 300 μl of isotype antibody i.p. at day 1 and 3, exposure to cigarette smoke. +CS, anti-GM-CSF AB: Mice treated with 300 μl anti-GM-CSF antibody i.p. at day 1 and 3, exposure to cigarette smoke. n=10 per group, mean±SEM, $*p<0.05$, $***p<0.001$.

The results shown in FIG. 9A and FIG. 9B demonstrate that GM-CSF plays a pivotal role in cigarette smoke-induced inflammation and that neutralisation of GM-CSF can significantly reduce cellular infiltration and inflammatory cytokines induced by long-term cigarette smoke exposure in mice.

Example 15 hGM-CSF Epitope Mapping

Peptide arrays containing, mouse, human, rhesus and marmoset GM-CSF peptides were tested to see whether particular linear sequence(s) in GM-CSF could be identified as the epitope recognized by the antibodies in question.

The following antibodies were tested: BIBH1 (An irrelevant humanized IgG1 negative control antibody recognizing FAP (See US20030103968 Use of FAP alpha specific antibody BIBH1 in the treatment of cancer (asco.org/ASCO/Abstracts+&+Virtual+Meeting/Abstracts?&vmview=abst_detail_view&confID=10&abstractID=1028), EV1018, EV1019 and EV1003.

Results from peptide arrays indicated that no specific binding above levels was seen with the negative control antibody, while immobilized GM-CSF and human IgG positive controls gave robust signals. Since properly folded GM-CSF is recognized but none of the GM-CSF derived peptides, we conclude that the anti-GM-CSF antibodies tested recognize a non-linear or conformation-specific epitope(s). This is in contrast to several other anti-GM-CSF antibodies known in the literature (e.g., WO2007/092939).

The following method was employed:

Custom arrays were synthesized and printed onto glass slides at JPT (Berlin, Germany). Arrays were blocked with PBS+1% BSA+0.1% Tween 20 for 3 h at room temperature with gentle shaking. Antibodies were diluted to 5 μg/ml in probing buffer (PBS, 5 mM $MgCl_2$, 0.5 mM DTT, 0.05% Triton X-100, 5% Glycerol, 1% BSA) and incubated on the arrays at 4° C. for 1-2 hours. Arrays were then washed with probing buffer thrice (1 minute on ice each wash) and then incubated with Cy5 labeled goat anti-human IgG (0.5 μg/ml) for 1 hour at 4° C. They were washed again as above, dried by centrifugation (800×g) and scanned in a Perkin-Elmer Proscan microarray scanner at constant PMT with the Cy5 filter set.

Epitope mapping via orthologous replacement was also performed. Since the antibodies tested recognize a conformational or discontinuous epitope, one can only determine the respective epitope in the context of properly folded GM-CSF. As shown in the Biacore results described above, the antibodies in question bind only weakly, if at all, to mouse GM-CSF. Therefore, we designed chimeric versions of GM-CSF in which selected regions of human GM-CSF were replaced by the corresponding mouse sequence. Since human and mouse GM-CSF presumably possess similar three dimensional structures but only 73% identity, the chimeric proteins should retain the proper GM-CSF fold, as opposed to alanine scanning methods (replacement with polyalanine stretches), which may affect folding of the protein. Chimeras in which the epitope, or parts thereof, are replaced with mouse sequences should no longer bind to the antibody in question (or show reduced binding). Mapping the sequences back onto the known human GM-CSF three dimensional structure allows one to reconstruct the spatial location of the amino acids comprising the epitope. Amino acids which are conserved between human and mouse GM-CSF cannot be analyzed with this method.

Eleven different chimeras were designed in which seven linear peptide sequences were replaced individually and in combination. For each chimera, mouse GM-CSF amino acids are indicated in boldface. Predicted N-linked glycosylation sites which differ between the chimeras are underlined. Each chimera was expressed in HEK 293 cells as a rabbit Fc fusion protein to allow purification and quantification via the rabbit Fc portion. A control Western blot with the fusion proteins using an antibody against rabbit Fc shows that identical amounts of the various GM-CSF chimeric fusion proteins were loaded onto the gels. Mobility shifts between the different chimeras are due to differences in glycosylation between human and mouse GM-CSF.

A Western blot of the GM-CSF chimeras with EV1003 shows that chimeras 3, 6, 9 and 10 show little or no binding. Chimera 9 is a combination of chimeras 3 and 6 while chimera 10 is a combination of chimeras 2 and 6. Therefore, all chimeras containing mouse amino acids in those positions represented by chimeras 3 and 6 or combinations containing one or both of these regions are no longer recognized by EV1003. These represent therefore the EV1003 epitope. Spatial mapping of chimeras 3 and 6 onto the 3 dimensional crystal structure of GM-CSF show that these chimeras lie adjacent to one another on one face of the GM-CSF molecule, in excellent agreement with these findings. This surface represents the discontinuous epitope recognized by EV1003.

A Western blot of the GM-CSF chimeras with EV1019 shows that chimeras 4, 5 and 11 show weak binding while chimera 8 shows nearly no binding. Chimera 11 is a combination of chimeras 1 and 5 while chimera 8 is a combination of chimeras 4 and 5. Therefore, all chimeras containing mouse amino acids in those positions represented by chimeras 4 or 5 show weak binding to EV1019. Chimera 8, which contains the combination of mouse amino acids in those positions represented by chimeras 4 and 5 is no longer recognized by EV1019. Therefore, the combination of chimeras 4 and 5 represent the EV1019 epitope. Spatial mapping of chimeras 4 and 5 onto the 3 dimensional crystal structure of GM-CSF show that these chimeras lie adjacent to one another on one face of the GM-CSF molecule, in excellent agreement with these findings. This surface represents the discontinuous epitope recognized by EV1019. Since both regions are necessary for high affinity binding of EV1019, the discontinuous epitope must be composed of the amino acids from variants 4 and 5 which lie in close proximity to one another and on or near the surface (and therefore affect the surface-exposed amino acid residues) of GM-CSF. These are amino acids 60-63 (ELYK) (SEQ ID NO: 2) and 78-87 (TMMASHYKQH) (SEQ ID NO: 3), respectively. A contribution from amino acid 76 (P) may be possible. It is unlikely that amino acids 68-69 (SL) in chimera 4 play a significant role in the binding epitope, due to the large distance from the interface between chimeras 4 and 5 involved, however, this cannot be completely ruled out.

A Western blot of the GM-CSF chimeras with EV1018 shows that chimeras 4, 5 and 11 show weak binding while chimera 8 shows nearly no binding. Chimera 11 is a combination of chimeras 1 and 5 while chimera 8 is a combination of chimeras 4 and 5. Therefore, all chimeras containing mouse amino acids in those positions represented by chimeras 4 or 5 show weak binding to EV1018. Chimera 8, which contains the combination of mouse amino acids in those positions represented by chimeras 4 and 5 is no longer recognized by EV1018. Therefore, the combination of chimeras 4 and 5 represent the EV1018 epitope. Spatial mapping of chimeras 4 and 5 onto the 3 dimensional crystal structure of GM-CSF show that these chimeras lie adjacent to one another on one face of the GM-CSF molecule, in excellent agreement with these findings. This surface represents the discontinuous epitope recognized by EV1018. Since both regions are necessary for high affinity binding of EV1018, the discontinuous epitope must be composed of the amino acids from variants 4 and 5 which lie in close proximity to one another and on or near the surface (and therefore affect the surface-exposed amino acid residues) of GM-CSF. These are amino acids "ELYK" (SEQ ID NO: 2) and "TMMASHYKQH (SEQ ID NO: 3)," respectively.

These results indicate that EV1018 and EV1019 recognize the same discontinuous epitope of the GM-CSF molecule, while EV1003 recognizes an epitope of the GM-CSF molecule that is distinct from the epitope recognized by EV1018 and EV1019.

LIST OF SEQUENCES

Full-Length hGM-CSF

```
MWLQSLLLLGTVACSISAPARSPSPSTQPWEHVNAIQEARRLLNLSRDTAAEMNETVEVISEMFDLQE
PTCLQTRLELYKQGLRGSLTKLKGPLTMMASHYKQHCPPTPETSCATQIITFESFKENLKDFLLVIPF
DCWEPVQE
(SEQ ID NO: 1)
```

-continued

Discontinuous Epitope for EV1018 & EV1019

>Residues 77-80
ELYK
(SEQ ID NO: 2)

Residues 95-104
TMMASHYKQH
(SEQ ID NO: 3)

EV1018 CDRs

>EV1018 HC CDR1
SYGMH
(SEQ ID NO: 4)

>EV1018 HC CDR2
LTYHHGNRKFYADSVRG
(SEQ ID NO: 5)

>EV1018 HC CDR3
ESMGAINDN
(SEQ ID NO: 6)

>EV1018 LC CDR1
IGNNNNIGSHAVG
(SEQ ID NO: 7)

>EV1018 LC CDR2
GRSPPS
(SEQ ID NO: 8)

>EV1018 LC CDR3
STWDSSLSAVV
(SEQ ID NO: 9)

EV1018 Heavy Chains without Signal Sequence

>EV1018
QVQLVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 10)

>EV1018-wt IgG1KO
QVELVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 11)

>EV1018-T97A IgG1KO
QVELVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 12)

>EV1018-T97V IgG1KO
QVELVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 13)

>EV1018-N95D IgG1KO
QVELVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSSASTKGPSVFPLAPSSKST

-continued

SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 14)

>EV1018-N95E IgG1KO
QVELVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 15)

>EV1018-N95K IgG1KO
QVELVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 16)

>EV1018-N95Q IgG1KO
QVELVESGGGMVQPGMPLRLSCVASGFTFSSYGMHWVRQAPGKGLEWVALTYHHGNRKFYADSVRGRF
TISRDNSQNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 17)

>EV1018-N93Q-N95T IgG1KO
QVELVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 18)

>EV1018-wt IgG1-BI
QVELVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 19)

>EV1018-T97A IgG1-BI
QVELVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 20)

>EV1018-T97V IgG1-BI
QVELVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 21)

>EV1018-N95D IgG1-BI
QVELVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN

-continued

HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 22)

>EV1018-N95E IgG1-BI
QVELVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 23)

>EV1018-N95K IgG1-BI
QVELVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 24)

>EV1018-N95Q IgG1-BI
QVELVESGGGMVQPGMPLRLSCVASGFTFSSYGMHWVRQAPGKGLEWVALTYHHGNRKFYADSVRGRF
TISRDNSQNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 25)

>EV1018-N93Q-N95T IgG1-BI
QVELVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 26)

>EV1018-T97A IgG1-original-constant
QVQLVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 27)

>EV1018-T97V IgG1-original-constant
QVQLVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 28)

>EV1018-N95D IgG1-original-constant
QVQLVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 29)

>EV1018-N95E IgG1-original-constant
QVQLVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP -continued EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 30)

>EV1018-N95K IgG1-original-constant
QVQLVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 31)

>EV1018-N95Q IgG1-original-constant
QVQLVESGGGMVQPGMPLRLSCVASGFTFSSYGMHWVRQAPGKGLEWVALTYHHGNRKFYADSVRGRF
TISRDNSQNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 32)

>EV1018-N93Q-N95T IgG1-original-constant
QVQLVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 33)

EV1018 Light Chains without Signal Sequence

>EV1018-wt-original
QSALTQETSVSGTVGQKVTLSCIGNNNNIGSHAVGWYQQISRGAPKMVLFGRSPPSGVPDRFSGSKSG
TTASLIISGLQPEDEADYYCSTWDSSLSAVVFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 34)

>EV1018-wt-BI
QSALTQETSVSGTVGQKVTLSCIGNNNNIGSHAVGWYQQISRGAPKMVLFGRSPPSGVPDRFSGSKSG
TTASLIISGLQPEDEADYYCSTWDSSLSAVVFGGGTKLTVLGQPKAAPSVTLFPPSSEELQANKATLV
CLISDFYPGAVTVAWKGDSSPVKAGVETTTPSKQSNNKYAASSYLSLTPEQWKSHRSYSCQVTHEGST
VEKTVAPTECS
(SEQ ID NO: 35)

>EV1018-wt-BI-G1
QSALTQETSVSGTVGQKVTLSCIGNNNNIGSHAVGWYQQISRGAPKMVLFGRSPPSGVPDRFSGSKSG
TTASLIISGLQPEDEADYYCSTWDSSLSAVVFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 36)

>EV1018-wt-original-constant
QSALTQETSVSGTVGQKVTLSCIGNNNNIGSHAVGWYQQISRGAPKMVLFGRSPPSGVPDRFSGSKSG
TTASLIISGLQPEDEADYYCSTWDSSLSAVVFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 37)

EV1018 Heavy Chains without Signal Sequence

>EV1018-wt-IgG1-KO-QVQL
QVQLVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 38)

>EV1018-T97A-IgG1-KO-QVQL
QVQLVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN

-continued

HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 39)

>EV1018-T97V-IgG1-KO-QVQL
QVQLVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 40)

>EV1018-N95D-IgG1-KO-QVQL
QVQLVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 41)

>EV1018-N95E IgG1-KO-QVQL
QVQLVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 42)

>EV1018-N95K IgG1-KO-QVQL
QVQLVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 43)

>EV1018-N95Q IgG1-KO-QVQL
QVQLVESGGGMVQPGMPLRLSCVASGFTFSSYGMHWVRQAPGKGLEWVALTYHHGNRKFYADSVRGRF
TISRDNSQNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 44)

>EV1018-N93Q-N95T IgG1-KO-QVQL
QVQLVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 45)

>EV1018-wt IgG1-QVQL-BI
QVQLVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 46)

>EV1018-T97A IgG1-QVQL-BI
QVQLVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP

-continued

EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 47)

>EV1018-T97V IgG1-QVQL-BI
QVQLVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 48)

>EV1018-N95D IgG1-QVQL-BI
QVQLVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 49)

>EV1018-N95E IgG1-QVQL-BI
QVQLVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 50)

>EV1018-N95K IgG1-QVQL-BI
QVQLVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 51)

>EV1018-N95Q IgG1-QVQL-BI
QVQLVESGGGMVQPGMPLRLSCVASGFTFSSYGMHWVRQAPGKGLEWVALTYHHGNRKFYADSVRGRF
TISRDNSQNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 52)

>EV1018-N93Q-N95T IgG1-QVQL-BI
QVQLVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 53)

>EV1018-IgG2
QVQLVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 54)

>EV1018-wt-IgG2
QVELVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP

-continued
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 55)

>EV1018-T97A-IgG2
QVELVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 56)

>EV1018-T97V-IgG2
QVELVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 57)

>EV1018-N95D-IgG2
QVELVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKMQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 58)

>EV1018-N95E-IgG2
QVELVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 59)

>EV1018-N95K-IgG2
QVELVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 60)

>EV1018-N95Q-IgG2
QVELVESGGGMVQPGMPLRLSCVASGFTFSSYGMHWVRQAPGKGLEWVALTYHHGNRKFYADSVRGRF
TISRDNSQNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 61)

>EV1018-N93Q-N95T-IgG2
QVELVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 62)

>EV1018-IgG4
QVQLVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ

-continued

PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 63)

>EV1018-wt-IgG4
QVELVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 64)

>EV1018-T97A-IgG4
QVELVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 65)

>EV1018-T97V-IgG4
QVELVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 66)

>EV1018-N95D-IgG4
QVELVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 67)

>EV1018-N95E-IgG4
QVELVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 68)

>EV1018-N95K-IgG4
QVELVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 69)

>EV1018-N95Q-IgG4
QVELVESGGGMVQPGMPLRLSCVASGFTFSSYGMHWVRQAPGKGLEWVALTYHHGNRKFYADSVRGRF
TISRDNSQNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 70)

>EV1018-N93Q-N95T-IgG4
QVELVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ

-continued

PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 71)

>EV1018-IgG4-SP
QVQLVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 72)

>EV1018-wt-IgG4-SP
QVELVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 73)

>EV1018-T97A-IgG4-SP
QVELVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 74)

>EV1018-T97V-IgG4-SP
QVELVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 75)

>EV1018-N95D-IgG4-SP
QVELVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 76)

>EV1018-N95E-IgG4-SP
QVELVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 77)

>EV1018-N95K-IgG4-SP
QVELVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 78)

>EV1018-N95Q-IgG4-SP
QVELVESGGGMVQPGMPLRLSCVASGFTFSSYGMHWVRQAPGKGLEWVALTYHHGNRKFYADSVRGRF
TISRDNSQNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ

-continued

PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 79)

>EV1018-N93Q-N95T-IgG4-SP
QVELVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 80)

EV1018 Heavy Chains with Signal Sequence

>EV1018
<u>MEFGLIWVFLVTLLRGVQC</u>QVQLVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 81)

>EV1018-wt-IgG1KO
<u>MGWSCIILFLVATATGVHS</u>QVELVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 82)

>EV1018-T97A-IgG1KO
<u>MGWSCIILFLVATATGVHS</u>QVELVESGGGMVQPGMPLRLSCVASGFTFSSYGMHWVRQAPGKGLEWVA
LTYHHGNRKFYADSVRGRFTISRDNSNNALYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 83)

>EV1018-T97V-IgG1KO
<u>MGWSCIILFLVATATGVHS</u>QVELVESGGGMVQPGMPLRLSCVASGFTFSSYGMHWVRQAPGKGLEWVA
LTYHHGNRKFYADSVRGRFTISRDNSNNVLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 84)

>EV1018-N95D-IgG1KO
<u>MGWSCIILFLVATATGVHS</u>QVELVESGGGMVQPGMPLRLSCVASGFTFSSYGMHWVRQAPGKGLEWVA
LTYHHGNRKFYADSVRGRFTISRDNSDNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 85)

>EV1018-N95E IgG1KO
<u>MGWSCIILFLVATATGVHS</u>QVELVESGGGMVQPGMPLRLSCVASGFTFSSYGMHWVRQAPGKGLEWVA
LTYHHGNRKFYADSVRGRFTISRDNSENTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 86)

>EV1018-N95K IgG1KO
<u>MGWSCIILFLVATATGVHS</u>QVELVESGGGMVQPGMPLRLSCVASGFTFSSYGMHWVRQAPGKGLEWVA
LTYHHGNRKFYADSVRGRFTISRDNSKNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM

-continued

ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 87)

>EV1018-N95Q IgG1KO
MGWSCIILFLVATATGVHSQVELVESGGGMVQPGMPLRLSCVASGFTFSSYGMHWVRQAPGKGLEWVA
LTYHHGNRKFYADSVRGRFTISRDNSQNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 88)

>EV1018-N93Q-N95T IgG1KO
MGWSCIILFLVATATGVHSQVELVESGGGMVQPGMPLRLSCVASGFTFSSYGMHWVRQAPGKGLEWVA
LTYHHGNRKFYADSVRGRFTISRDQSTNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 89)

>EV1018-wt IgG1-BI
MGWSCIILFLVATATGVHSQVELVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 90)

>EV1018-T97A IgG1-BI
MGWSCIILFLVATATGVHSQVELVESGGGMVQPGMPLRLSCVASGFTFSSYGMHWVRQAPGKGLEWVA
LTYHHGNRKFYADSVRGRFTISRDNSNNALYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 91)

>EV1018-T97V IgG1-BI
MGWSCIILFLVATATGVHSQVELVESGGGMVQPGMPLRLSCVASGFTFSSYGMHWVRQAPGKGLEWVA
LTYHHGNRKFYADSVRGRFTISRDNSNNVLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 92)

>EV1018-N95D IgG1-BI
MGWSCIILFLVATATGVHSQVELVESGGGMVQPGMPLRLSCVASGFTFSSYGMHWVRQAPGKGLEWVA
LTYHHGNRKFYADSVRGRFTISRDNSDNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 93)

>EV1018-N95E IgG1-BI
MGWSCIILFLVATATGVHSQVELVESGGGMVQPGMPLRLSCVASGFTFSSYGMHWVRQAPGKGLEWVA
LTYHHGNRKFYADSVRGRFTISRDNSENTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 94)

>EV1018-N95K IgG1-BI
MGWSCIILFLVATATGVHSQVELVESGGGMVQPGMPLRLSCVASGFTFSSYGMHWVRQAPGKGLEWVA
LTYHHGNRKFYADSVRGRFTISRDNSKNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK

-continued

CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 95)

>EV1018-N95Q IgG1-BI
MGWSCIILFLVATATGVHSQVELVESGGGMVQPGMPLRLSCVASGFTFSSYGMHWVRQAPGKGLEWVA
LTYHHGNRKFYADSVRGRFTISRDNSQNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 96)

>EV1018-N93Q-N95T IgG1-BI
MGWSCIILFLVATATGVHSQVELVESGGGMVQPGMPLRLSCVASGFTFSSYGMHWVRQAPGKGLEWVA
LTYHHGNRKFYADSVRGRFTISRDQSTNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 97)

>EV1018-T97A IgG1-original-constant
MGWSCIILFLVATATGVHSQVQLVESGGGMVQPGMPLRLSCVASGFTFSSYGMHWVRQAPGKGLEWVA
LTYHHGNRKFYADSVRGRFTISRDNSNNALYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 98)

>EV1018-T97V IgG1-original-constant
MGWSCIILFLVATATGVHSQVQLVESGGGMVQPGMPLRLSCVASGFTFSSYGMHWVRQAPGKGLEWVA
LTYHHGNRKFYADSVRGRFTISRDNSNNVLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 99)

>EV1018-N95D IgG1-original-constant
MGWSCIILFLVATATGVHSQVQLVESGGGMVQPGMPLRLSCVASGFTFSSYGMHWVRQAPGKGLEWVA
LTYHHGNRKFYADSVRGRFTISRDNSDNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 100)

>EV1018-N95E IgG1-original-constant
MGWSCIILFLVATATGVHSQVQLVESGGGMVQPGMPLRLSCVASGFTFSSYGMHWVRQAPGKGLEWVA
LTYHHGNRKFYADSVRGRFTISRDNSENTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 101)

>EV1018-N95K IgG1-original-constant
MGWSCIILFLVATATGVHSQVQLVESGGGMVQPGMPLRLSCVASGFTFSSYGMHWVRQAPGKGLEWVA
LTYHHGNRKFYADSVRGRFTISRDNSKNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 102)

>EV1018-N95Q IgG1-original-constant
MGWSCIILFLVATATGVHSQVQLVESGGGMVQPGMPLRLSCVASGFTFSSYGMHWVRQAPGKGLEWVA
LTYHHGNRKFYADSVRGRFTISRDNSQNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK -continued CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 103)

>EV1018-N93Q-N95T IgG1-original-constant
MGWSCIILFLVATATGVHSQVQLVESGGGMVQPGMPLRLSCVASGFTFSSYGMHWVRQAPGKGLEWVA
LTYHHGNRKFYADSVRGRFTISRDQSTNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 104)

EV1018 Light chains with Signal Sequence

>EV1018-wt-original
MAWTPLLLQLLTLCSGSWAQSALTQETSVSGTVGQKVTLSCIGNNNNIGSHAVGWYQQISRGAPKMVL
FGRSPPSGVPDRFSGSKSGTTASLIISGLQPEDEADYYCSTWDSSLSAVVFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 105)

>EV1018-wt-BI
MGWSCIILFLVATATGVHSQSALTQETSVSGTVGQKVTLSCIGNNNNIGSHAVGWYQQISRGAPKMVL
FGRSPPSGVPDRFSGSKSGTTASLIISGLQPEDEADYYCSTWDSSLSAVVFGGGTKLTVLGQPKAAPS
VTLFPPSSEELQANKATLVCLISDFYPGAVTVAWKGDSSPVKAGVETTTPSKQSNNKYAASSYLSLTP
EQWKSHRSYSCQVTHEGSTVEKTVAPTECS
(SEQ ID NO: 106)

>EV1018-wt-BI2 (G1)
MGWSCIILFLVATATGVHSQSALTQETSVSGTVGQKVTLSCIGNNNNIGSHAVGWYQQISRGAPKMVL
FGRSPPSGVPDRFSGSKSGTTASLIISGLQPEDEADYYCSTWDSSLSAVVFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 107)

>EV1018-wt-original-constant
MGWSCIILFLVATATGVHSQSALTQETSVSGTVGQKVTLSCIGNNNNIGSHAVGWYQQISRGAPKMVL
FGRSPPSGVPDRFSGSKSGTTASLIISGLQPEDEADYYCSTWDSSLSAVVFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 108)

EV1018 Heavy Chains with Signal Sequence

>EV1018-wt-IgG1-KO-QVQL
MGWSCIILFLVATATGVHSQVQLVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 109)

>EV1018-T97A-IgG1-KO-QVQL
MGWSCIILFLVATATGVHSQVQLVESGGGMVQPGMPLRLSCVASGFTFSSYGMHWVRQAPGKGLEWVA
LTYHHGNRKFYADSVRGRFTISRDNSNNALYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 110)

>EV1018-T97V-IgG1-KO-QVQL
MGWSCIILFLVATATGVHSQVQLVESGGGMVQPGMPLRLSCVASGFTFSSYGMHWVRQAPGKGLEWVA
LTYHHGNRKFYADSVRGRFTISRDNSNNVLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 111)

>EV1018-N95D-IgG1-KO-QVQL
MGWSCIILFLVATATGVHSQVQLVESGGGMVQPGMPLRLSCVASGFTFSSYGMHWVRQAPGKGLEWVA
LTYHHGNRKFYADSVRGRFTISRDNSDNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM

-continued

ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 112)

>EV1018-N95E IgG1-KO-QVQL
MGWSCIILFLVATATGVHSQVQLVESGGGMVQPGMPLRLSCVASGFTFSSYGMHWVRQAPGKGLEWVA
LTYHHGNRKFYADSVRGRFTISRDNSENTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 113)

>EV1018-N95K IgG1-KO-QVQL
MGWSCIILFLVATATGVHSQVQLVESGGGMVQPGMPLRLSCVASGFTFSSYGMHWVRQAPGKGLEWVA
LTYHHGNRKFYADSVRGRFTISRDNSKNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 114)

>EV1018-N95Q IgG1-KO-QVQL
MGWSCIILFLVATATGVHSQVQLVESGGGMVQPGMPLRLSCVASGFTFSSYGMHWVRQAPGKGLEWVA
LTYHHGNRKFYADSVRGRFTISRDNSQNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 115)

>EV1018-N93Q-N95T IgG1-KO-QVQL
MGWSCIILFLVATATGVHSQVQLVESGGGMVQPGMPLRLSCVASGFTFSSYGMHWVRQAPGKGLEWVA
LTYHHGNRKFYADSVRGRFTISRDQSTNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 116)

>EV1018-wt IgG1-QVQL-BI
MGWSCIILFLVATATGVHSQVQLVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 117)

>EV1018-T97A IgG1-QVQL-BI
MGWSCIILFLVATATGVHSQVQLVESGGGMVQPGMPLRLSCVASGFTFSSYGMHWVRQAPGKGLEWVA
LTYHHGNRKFYADSVRGRFTISRDNSNNALYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 118)

>EV1018-T97V IgG1-QVQL-BI
MGWSCIILFLVATATGVHSQVQLVESGGGMVQPGMPLRLSCVASGFTFSSYGMHWVRQAPGKGLEWVA
LTYHHGNRKFYADSVRGRFTISRDNSNNVLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 119)

>EV1018-N95D IgG1-QVQL-BI
MGWSCIILFLVATATGVHSQVQLVESGGGMVQPGMPLRLSCVASGFTFSSYGMHWVRQAPGKGLEWVA
LTYHHGNRKFYADSVRGRFTISRDNSDNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK

-continued

CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 120)

>EV1018-N95E IgG1-QVQL-BI
<u>MGWSCIILFLVATATGVHS</u>QVQLVESGGGMVQPGMPLRLSCVASGFTFSSYGMHWVRQAPGKGLEWVA
LTYHHGNRKFYADSVRGRFTISRDNSENTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 121)

>EV1018-N95K IgG1-QVQL-BI
<u>MGWSCIILFLVATATGVHS</u>QVQLVESGGGMVQPGMPLRLSCVASGFTFSSYGMHWVRQAPGKGLEWVA
LTYHHGNRKFYADSVRGRFTISRDNSKNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 122)

>EV1018-N95Q IgG1-QVQL-BI
<u>MGWSCIILFLVATATGVHS</u>QVQLVESGGGMVQPGMPLRLSCVASGFTFSSYGMHWVRQAPGKGLEWVA
LTYHHGNRKFYADSVRGRFTISRDNSQNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 123)

>EV1018-N93Q-N95T IgG1-QVQL-BI
<u>MGWSCIILFLVATATGVHS</u>QVQLVESGGGMVQPGMPLRLSCVASGFTFSSYGMHWVRQAPGKGLEWVA
LTYHHGNRKFYADSVRGRFTISRDQSTNTLYLQMTSLRAEDTAVYFCARESMGAINDNWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 124)

>EV1018-IgG2
<u>MEFGLIWVFLVTLLRGVQC</u>QVQLVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 125)

>EV1018-wt-IgG2
<u>MGWSCIILFLVATATGVHS</u>QVELVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 126)

>EV1018-T97A-IgG2
<u>MGWSCIILFLVATATGVHS</u>QVELVESGGGMVQPGMPLRLSCVASGFTFSSYGMHWVRQAPGKGLEWVA
LTYHHGNRKFYADSVRGRFTISRDNSNNALYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHUHYTQKSLSLSPGK
(SEQ ID NO: 127)

>EV1018-T97V-IgG2
<u>MGWSCIILFLVATATGVHS</u>QVELVESGGGMVQPGMPLRLSCVASGFTFSSYGMHWVRQAPGKGLEWVA
LTYHHGNRKFYADSVRGRFTISRDNSNNVLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS

-continued

NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 128)

>EV1018-N95D-IgG2
MGWSCIILFLVATATGVHSQVELVESGGGMVQPGMPLRLSCVASGFTFSSYGMHWVRQAPGKGLEWVA
LTYHHGNRKFYADSVRGRFTISRDNSDNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 129)

>EV1018-N95E-IgG2
MGWSCIILFLVATATGVHSQVELVESGGGMVQPGMPLRLSCVASGFTFSSYGMHWVRQAPGKGLEWVA
LTYHHGNRKFYADSVRGRFTISRDNSENTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 130)

>EV1018-N95K-IgG2
MGWSCIILFLVATATGVHSQVELVESGGGMVQPGMPLRLSCVASGFTFSSYGMHWVRQAPGKGLEWVA
LTYHHGNRKFYADSVRGRFTISRDNSKNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 131)

>EV1018-N95Q-IgG2
MGWSCIILFLVATATGVHSQVELVESGGGMVQPGMPLRLSCVASGFTFSSYGMHWVRQAPGKGLEWVA
LTYHHGNRKFYADSVRGRFTISRDNSQNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 132)

>EV1018-N93Q-N95T-IgG2
MGWSCIILFLVATATGVHSQVELVESGGGMVQPGMPLRLSCVASGFTFSSYGMHWVRQAPGKGLEWVA
LTYHHGNRKFYADSVRGRFTISRDQSTNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 133)

>EV1018-IgG4
MEFGLIWVFLVTLLRGVQCQVQLVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 134)

>EV1018-wt-IgG4
MGWSCIILFLVATATGVHSQVELVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 135)

>EV1018-T97A-IgG4
MGWSCIILFLVATATGVHSQVELVESGGGMVQPGMPLRLSCVASGFTFSSYGMHWVRQAPGKGLEWVA
LTYHHGNRKFYADSVRGRFTISRDNSNNALYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV

-continued

SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 136)

>EV1018-T97V-IgG4
MGWSCIILFLVATATGVHSQVELVESGGGMVQPGMPLRLSCVASGFTFSSYGMHWVRQAPGKGLEWVA
LTYHHGNRKFYADSVRGRFTISRDNSNNVLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 137)

>EV1018-N95D-IgG4
MGWSCIILFLVATATGVHSQVELVESGGGMVQPGMPLRLSCVASGFTFSSYGMHWVRQAPGKGLEWVA
LTYHHGNRKFYADSVRGRFTISRDNSDNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 138)

>EV1018-N95E-IgG4
MGWSCIILFLVATATGVHSQVELVESGGGMVQPGMPLRLSCVASGFTFSSYGMHWVRQAPGKGLEWVA
LTYHHGNRKFYADSVRGRFTISRDNSENTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 139)

>EV1018-N95K-IgG4
MGWSCIILFLVATATGVHSQVELVESGGGMVQPGMPLRLSCVASGFTFSSYGMHWVRQAPGKGLEWVA
LTYHHGNRKFYADSVRGRFTISRDNSKNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 140)

>EV1018-N95Q-IgG4
MGWSCIILFLVATATGVHSQVELVESGGGMVQPGMPLRLSCVASGFTFSSYGMHWVRQAPGKGLEWVA
LTYHHGNRKFYADSVRGRFTISRDNSQNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 141)

>EV1018-N93Q-N95T-IgG4
MGWSCIILFLVATATGVHSQVELVESGGGMVQPGMPLRLSCVASGFTFSSYGMHWVRQAPGKGLEWVA
LTYHHGNRKFYADSVRGRFTISRDQSTNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 142)

>EV1018-IgG4-SP
MEFGLIWVFLVTLLRGVQCQVQLVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 143)

>EV1018-wt-IgG4-SP
MGWSCIILFLVATATGVHSQVELVESGGGMVQPGMPLRLSCVASGFTFSSYGMHWVRQAPGKGLEWVA
LTYHHGNRKFYADSVRGRFTISRDNSNNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV

-continued

SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 144)

>EV1018-T97A-IgG4-SP
MGWSCIILFLVATATGVHSQVELVESGGGMVQPGMPLRLSCVASGFTFSSYGMHWVRQAPGKGLEWVA
LTYHHGNRKFYADSVRGRFTISRDNSNNALYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 145)

>EV1018-T97V-IgG4-SP
MGWSCIILFLVATATGVHSQVELVESGGGMVQPGMPLRLSCVASGFTFSSYGMHWVRQAPGKGLEWVA
LTYHHGNRKFYADSVRGRFTISRDNSNNVLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 146)

>EV1018-N95D-IgG4-SP
MGWSCIILFLVATATGVHSQVELVESGGGMVQPGMPLRLSCVASGFTFSSYGMHWVRQAPGKGLEWVA
LTYHHGNRKFYADSVRGRFTISRDNSDNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 147)

>EV1018-N95E-IgG4-SP
MGWSCIILFLVATATGVHSQVELVESGGGMVQPGMPLRLSCVASGFTFSSYGMHWVRQAPGKGLEWVA
LTYHHGNRKFYADSVRGRFTISRDNSENTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 148)

>EV1018-N95K-IgG4-SP
MGWSCIILFLVATATGVHSQVELVESGGGMVQPGMPLRLSCVASGFTFSSYGMHWVRQAPGKGLEWVA
LTYHHGNRKFYADSVRGRFTISRDNSKNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 149)

>EV1018-N95Q-IgG4-SP
MGWSCIILFLVATATGVHSQVELVESGGGMVQPGMPLRLSCVASGFTFSSYGMHWVRQAPGKGLEWVA
LTYHHGNRKFYADSVRGRFTISRDNSQNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 150)

>EV1018-N93Q-N95T-IgG4-SP
MGWSCIILFLVATATGVHSQVELVESGGGMVQPGMPLRLSCVASGFTFSSYGMHWVRQAPGKGLEWVA
LTYHHGNRKFYADSVRGRFTISRDQSTNTLYLQMTSLRAEDTAVYFCARESMGAINDNWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 151)

EV1019 Heavy Chain Variable Regions without Signal Sequence

>EV1019-VH-wt
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTCDSWGQGTLVIVSS
(SEQ ID NO: 152)

-continued

>EV1019-VH-C105G
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTGDSWGQGTLVIVSS
(SEQ ID NO: 153)

>EV1019-VH-C105S
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTSDSWGQGTLVIVSS
(SEQ ID NO: 154)

>EV1019-VH-C105A
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTADSWGQGTLVIVSS
(SEQ ID NO: 155)

>EV1019-VH-C105T
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTTDSWGQGTLVIVSS
(SEQ ID NO: 156)

>EV1019-VH-C105M
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTMDSWGQGTLVIVSS
(SEQ ID NO: 157)

>EV1019-VH-C105Q
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTQDSWGQGTLVIVSS
(SEQ ID NO: 158)

>EV1019-VH-C105L
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTLDSWGQGTLVIVSS
(SEQ ID NO: 159)

EV1019 Heavy Chains without Signal Sequence

>EV1019
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTCDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 160)

>EV1019-wt-IgG1-BI
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTCDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 161)

>EV1019-wt-IgG1KO
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTCDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 162)

>EV1019-C105G
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTGDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 163)

>EV1019-C105G-IgG1-BI
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTGDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN

-continued
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 164)

>EV1019-C105G-IgG1KO
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTGDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 165)

>EV1019-C105S
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTSDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 166)

>EV1019-C105S-IgG1-BI
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTSDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 167)

>EV1019-C105S-IgG1KO
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTSDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 168)

>EV1019-C105A
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTADSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 169)

>EV1019-C105A-IgG1-BI
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTADSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 170)

>EV1019-C105A-IgG1KO
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTADSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 171)

>EV1019-C105Q
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTQDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP

-continued

EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 172)

>EV1019-C105Q-IgG1-BI
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTQDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 173)

>EV1019-C105Q-IgG1KO
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTQDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 174)

>EV1019-C105T
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTTDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 175)

>EV1019-C105T-IgG1-BI
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTTDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 176)

>EV1019-C105T-IgG1KO
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTTDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 177)

>EV1019-C105M
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTMDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 178)

>EV1019-C105M-IgG1-BI
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTMDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 179)

>EV1019-C105M-IgG1KO
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTMDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA

-continued

KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 180)

>EV1019-C105L
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTLDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 181)

>EV1019-C105L-IgG1-BI
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTLDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 182)

>EV1019-C105L-IgG1KO
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTLDSWGQGTLVIVSSASTKGPSVFPLAPSSKST
SGGTAALGCLVKDYFPEPVTVSWNSGALTSGVHTFPAVLQSSGLYSLSSVVTVPSSSLGTQTYICNVN
HKPSNTKVDKRVEPKSCDKTHTCPPCPAPEAAGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISKA
KGQPREPQVYTLPPSRDELTKNQVSLTCLVKGFYPSDIAVEWESNGQPENNYKTTPPVLDSDGSFFLY
SKLTVDKSRWQQGNVFSCSVMHEALHNHYTQKSLSLSPGK
(SEQ ID NO: 183)

EV1019 Light Chain Variable Regions without Signal Sequence

>EV1019-VL-wt
QPALTQEASVSGTVGQTVTLLCSGNSSNIGSYAVGWYQQISRGAPKIVVFGKSPASGIPDRFSGSKSG
TTASLLVSGLQPEDEADYYCSTWDSRLSAVLFGGGTKLTVLR
(SEQ ID NO: 184)

>EV1019-VL-BI
QPALTQEASVSGTVGQTVTLLCSGNSSNIGSYAVGWYQQISRGAPKIVVFGKSPASGIPDRFSGSKSG
TTASLLVSGLQPEDEADYYCSTWDSRLSAVLFGGGTKLTVLG
(SEQ ID NO: 185)

>EV1019-VL-N25S
QPALTQEASVSGTVGQTVTLLCSGSSSNIGSYAVGWYQQISRGAPKIVVFGKSPASGIPDRFSGSKSG
TTASLLVSGLQPEDEADYYCSTWDSRLSAVLFGGGTKLTVLR
(SEQ ID NO: 186)

>EV1019-VL-BI-N25S
QPALTQEASVSGTVGQTVTLLCSGSSSNIGSYAVGWYQQISRGAPKIVVFGKSPASGIPDRFSGSKSG
TTASLLVSGLQPEDEADYYCSTWDSRLSAVLFGGGTKLTVLG
(SEQ ID NO: 187)

>EV1019-VL-N25G
QPALTQEASVSGTVGQTVTLLCSGGSSNIGSYAVGWYQQISRGAPKIVVFGKSPASGIPDRFSGSKSG
TTASLLVSGLQPEDEADYYCSTWDSRLSAVLFGGGTKLTVLR
(SEQ ID NO: 188)

>EV1019-VL-BI-N25G
QPALTQEASVSGTVGQTVTLLCSGGSSNIGSYAVGWYQQISRGAPKIVVFGKSPASGIPDRFSGSKSG
TTASLLVSGLQPEDEADYYCSTWDSRLSAVLFGGGTKLTVLG
(SEQ ID NO: 189)

>EV1019-VL-N25T
QPALTQEASVSGTVGQTVTLLCSGTSSNIGSYAVGWYQQISRGAPKIVVFGKSPASGIPDRFSGSKSG
TTASLLVSGLQPEDEADYYCSTWDSRLSAVLFGGGTKLTVLR
(SEQ ID NO: 190)

>EV1019-VL-BI-N25T
QPALTQEASVSGTVGQTVTLLCSGTSSNIGSYAVGWYQQISRGAPKIVVFGKSPASGIPDRFSGSKSG
TTASLLVSGLQPEDEADYYCSTWDSRLSAVLFGGGTKLTVLG
(SEQ ID NO: 191)

>EV1019-VL-N25R
QPALTQEASVSGTVGQTVTLLCSGRSSNIGSYAVGWYQQISRGAPKIVVFGKSPASGIPDRFSGSKSG
TTASLLVSGLQPEDEADYYCSTWDSRLSAVLFGGGTKLTVLR
(SEQ ID NO: 192)

-continued

>EV1019-VL-BI-N25R
QPALTQEASVSGTVGQTVTLLCSGRSSNIGSYAVGWYQQISRGAPKIVVFGKSPASGIPDRFSGSKSG
TTASLLVSGLQPEDEADYYCSTWDSRLSAVLFGGGTKLTVLG
(SEQ ID NO: 193)

>EV1019-VL-N25Q
QPALTQEASVSGTVGQTVTLLCSGQSSNIGSYAVGWYQQISRGAPKIVVFGKSPASGIPDRFSGSKSG
TTASLLVSGLQPEDEADYYCSTWDSRLSAVLFGGGTKLTVLR
(SEQ ID NO: 194)

>EV1019-VL-BI-N25Q
QPALTQEASVSGTVGQTVTLLCSGQSSNIGSYAVGWYQQISRGAPKIVVFGKSPASGIPDRFSGSKSG
TTASLLVSGLQPEDEADYYCSTWDSRLSAVLFGGGTKLTVLG
(SEQ ID NO: 195)

>EV1019-VL-S27N
QPALTQEASVSGTVGQTVTLLCSGNSNNIGSYAVGWYQQISRGAPKIVVFGKSPASGIPDRFSGSKSG
TTASLLVSGLQPEDEADYYCSTWDSRLSAVLFGGGTKLTVLR
(SEQ ID NO: 196)

>EV1019-VL-BI-S27N
QPALTQEASVSGTVGQTVTLLCSGNSNNIGSYAVGWYQQISRGAPKIVVFGKSPASGIPDRFSGSKSG
TTASLLVSGLQPEDEADYYCSTWDSRLSAVLFGGGTKLTVLG
(SEQ ID NO: 197)

>EV1019-VL-S27G
QPALTQEASVSGTVGQTVTLLCSGNSGNIGSYAVGWYQQISRGAPKIVVFGKSPASGIPDRFSGSKSG
TTASLLVSGLQPEDEADYYCSTWDSRLSAVLFGGGTKLTVLR
(SEQ ID NO: 198)

>EV1019-VL-BI-S27G
QPALTQEASVSGTVGQTVTLLCSGNSGNIGSYAVGWYQQISRGAPKIVVFGKSPASGIPDRFSGSKSG
TTASLLVSGLQPEDEADYYCSTWDSRLSAVLFGGGTKLTVLG
(SEQ ID NO: 199)

>EV1019-VL-S27A
QPALTQEASVSGTVGQTVTLLCSGNSANIGSYAVGWYQQISRGAPKIVVFGKSPASGIPDRFSGSKSG
TTASLLVSGLQPEDEADYYCSTWDSRLSAVLFGGGTKLTVLR
(SEQ ID NO: 200)

>EV1019-VL-BI-S27A
QPALTQEASVSGTVGQTVTLLCSGNSANIGSYAVGWYQQISRGAPKIVVFGKSPASGIPDRFSGSKSG
TTASLLVSGLQPEDEADYYCSTWDSRLSAVLFGGGTKLTVLG
(SEQ ID NO: 201)

EV1019 Light Chains without Signal Sequence

>EV1019-wt-original
QPALTQEASVSGTVGQTVTLLCSGNSSNIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 202)

>EV1019-wt-BI
QPALTQEASVSGTVGQTVTLLCSGNSSNIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKGDSSPVKAGVETTTPSKQSNNKYAASSYLSLTPEQWKSHRSYSCQVTHEGST
VEKTVAPTECS
(SEQ ID NO: 203)

>EV1019-wt-BI2
QPALTQEASVSGTVGQTVTLLCSGNSSNIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 204)

>EV1019-wt-original-constant
QPALTQEASVSGTVGQTVTLLCSGNSSNIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 205)

>EV1019-N25S
QPALTQEASVSGTVGQTVTLLCSGSSSNIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV

-continued

CLISDFYPGAVTVAWKADSSPVKAGVETTTPSKQSNNKYAASSYLSLTPEQWKSHRSYSCQVTHEGST
VEKTVAPTECS
(SEQ ID NO: 206)

>EV1019-N25S-BI2
QPALTQEASVSGTVGQTVTLLCSGSSSNIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 207)

>EV1019-N25G
QPALTQEASVSGTVGQTVTLLCSGGSSNIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 208)

>EV1019-N25G-BI2
QPALTQEASVSGTVGQTVTLLCSGGSSNIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 209)

>EV1019-N25T
QPALTQEASVSGTVGQTVTLLCSGTSSNIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 210)

>EV1019-N25T-BI2
QPALTQEASVSGTVGQTVTLLCSGTSSNIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 211)

>EV1019-N25R
QPALTQEASVSGTVGQTVTLLCSGRSSNIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 212)

>EV1019-N25R-BI2
QPALTQEASVSGTVGQTVTLLCSGRSSNIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 213)

>EV1019-N25Q
QPALTQEASVSGTVGQTVTLLCSGQSSNIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 214)

>EV1019-N25Q-BI2
QPALTQEASVSGTVGQTVTLLCSGQSSNIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 215)

>EV1019-S27N
QPALTQEASVSGTVGQTVTLLCSGNSNNIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 216)

>EV1019-S27N-BI2
QPALTQEASVSGTVGQTVTLLCSGNSNNIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 217)

-continued

>EV1019-S27G
QPALTQEASVSGTVGQTVTLLCSGNSGNIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 218)

>EV1019-S27G-BI2
QPALTQEASVSGTVGQTVTLLCSGNSGNIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 219)

>EV1019-S27A
QPALTQEASVSGTVGQTVTLLCSGNSANIGSYAVGWYQQISRGAPKIVVFGKSPASGIPDRFSGSKSG
TTASLLVSGLQPEDEADYYCSTWDSRLSAVLFGGGTKLTVLRQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 220)

>EV1019-S27A-BI2
QPALTQEASVSGTVGQTVTLLCSGNSANIGSYAVGWYQQISRGAPKIVVFGKSPASGIPDRFSGSKSG
TTASLLVSGLQPEDEADYYCSTWDSRLSAVLFGGGTKLTVLGQPKAAPSVTLFPPSSEELQANKATLV
CLISDFYPGAVTVAWKADSSPVKAGVETTTPSKQSNNKYAASSYLSLTPEQWKSHRSYSCQVTHEGST
VEKTVAPTECS
(SEQ ID NO: 221)

EV1019 Heavy Chains without Signal Sequence

>EV1019-IgG2
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTCDSWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 222)

>EV1019-wt-IgG4
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTCDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 223)

>EV1019-wt-IgG4SP
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTCDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 224)

>EV1019-C105G-IgG2
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTGDSWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 225)

>EV1019-C105G-IgG4
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTGDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 226)

-continued

>EV1019-C105G-IgG4SP
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTGDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 227)

>EV1019-C105S-IgG2
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTSDSWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 228)

>EV1019-C105S-IgG4
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTSDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 229)

>EV1019-C105S-IgG4SP
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTSDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 230)

>EV1019-C105A-IgG2
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTADSWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 231)

>EV1019-C105A-IgG4
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTADSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 232)

>EV1019-C105A-IgG4SP
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTADSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 233)

>EV1019-C105Q-IgG2
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTQDSWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 234)

-continued

>EV1019-C105Q-IgG4
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTQDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 235)

>EV1019-C105Q-IgG4SP
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTQDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 236)

>EV1019-C105T-IgG2
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTTDSWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 237)

>EV1019-C105T-IgG4
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTTDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 238)

>EV1019-C105T-IgG4SP
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTTDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 239)

>EV1019-C105M-IgG2
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTMDSWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 240)

>EV1019-C105M-IgG4
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTMDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID. NO: 241)

>EV1019-C105M-IgG4SP
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTMDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 242)

>EV1019-C105L-IgG2

-continued

QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTLDSWGQGTLVIVSSASTKGPSVFPLAPCSRST
SESTAALGCLVKDYFPEPVTVSWNSGALTSGVHTFPAVLQSSGLYSLSSVVTVPSSNFGTQTYTCNVD
HKPSNTKVDKTVERKCCVECPPCPAPPVAGPSVFLFPPKPKDTLMISRTPEVTCVVVDVSHEDPEVQF
NWYVDGVEVHNAKTKPREEQFNSTFRVVSVLTVVHQDWLNGKEYKCKVSNKGLPAPIEKTISKTKGQP
REPQVYTLPPSREEMTKNQVSLTCLVKGFYPSDIAVEWESNGQPENNYKTTPPMLDSDGSFFLYSKLT
VDKSRWQQGNVFSCSVMHEALHNHYTQKSLSLSPGK
(SEQ ID NO: 243)

>EV1019-C105L-IgG4
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTLDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 244)

>EV1019-C105L-IgG4SP
QAQLVESGGGVVKPGGSLRLSCISSKFTFSSHAMHWVRQAPGKGLEWVAVIWHDGSKKYYADSVKGRF
SVSRDNSKNTLFLQMDSLRAEDTAVYFCGKEWVGGTLDSWGQGTLVIVSSASTKGPSVFPLAPCSRST
SESTAALGCLVKDYFPEPVTVSWNSGALTSGVHTFPAVLQSSGLYSLSSVVTVPSSSLGTKTYTCNVD
HKPSNTKVDKRVESKYGPPCPPCPAPEFLGGPSVFLFPPKPKDTLMISRTPEVTCVVVDVSQEDPEVQ
FNWYVDGVEVHNAKTKPREEQFNSTYRVVSVLTVLHQDWLNGKEYKCKVSNKGLPSSIEKTISKAKGQ
PREPQVYTLPPSQEEMTKNQVSLTCLVKGFYPSDIAVEWESNGQPENNYKTTPPVLDSDGSFFLYSRL
TVDKSRWQEGNVFSCSVMHEALHNHYTQKSLSLSLGK
(SEQ ID NO: 245)

EV1019 Heavy Chains with Signal Sequence

>EV1019
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTCDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 246)

>EV1019-wt-IgG1-BI
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTCDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 247)

>EV1019-wt-IgG1KO
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTCDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 248)

>EV1019-C105G
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTGDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 249)

>EV1019-C105G-IgG1-BI
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTGDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK

-continued

CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 250)

>EV1019-C105G-IgG1KO
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTGDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 251)

>EV1019-C105S
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTSDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 252)

>EV1019-C105S-IgG1-BI
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTSDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 253)

>EV1019-C105S-IgG1KO
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTSDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 254)

>EV1019-C105A
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTADSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 255)

>EV1019-C105A-IgG1-BI
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTADSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 256)

>EV1019-C105A-IgG1KO
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTADSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 257)

>EV1019-C105Q
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTQDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK

-continued
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 258)

>EV1019-C105Q-IgG1-BI
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTQDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 259)

>EV1019-C105Q-IgG1KO
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTQDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 260)

>EV1019-C105T
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTTDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 261)

>EV1019-C105T-IgG1-BI
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTTDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 262)

>EV1019-C105T-IgG1KO
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTTDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 263)

>EV1019-C105M
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTMDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 264)

>EV1019-C105M-IgG1-BI
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTMDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 265)

>EV1019-C105M-IgG1KO
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTMDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK

-continued

CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 266)

>EV1019-C105L
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTLDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKKVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 267)

>EV1019-C105L-IgG1-BI
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTLDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPELLGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 268)

>EV1019-C105L-IgG1KO
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTLDSWGQGTLVIVS
SASTKGPSVFPLAPSSKSTSGGTAALGCLVKDYFPEPVTVSWNSGALTSGVHTFPAVLQSSGLYSLSS
VVTVPSSSLGTQTYICNVNHKPSNTKVDKRVEPKSCDKTHTCPPCPAPEAAGGPSVFLFPPKPKDTLM
ISRTPEVTCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNGQPE
NNYKTTPPVLDSDGSFFLYSKLTVDKSRWQQGNVFSCSVMHEALHNHYTQKSLSLSPGK
(SEQ ID NO: 269)

EV1019 Light Chains with Signal Sequence

>EV1019-wt-original
MAWTPLLLQLLTLCSGSWAQPALTQEASVSGTVGQTVTLLCSGNSSNIGSYAVGWYQQISRGAPKIVV
FGKSPASGIPDRFSGSKSGTTASLLVSGLQPEDEADYYCSTWDSRLSAVLFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 270)

>EV1019-wt-BI
MGWSCIILFLVATATGVHSQPALTQEASVSGTVGQTVTLLCSGNSSNIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKGDSSPVKAGVETTTPSKQSNNKYAASSYLSLTP
EQWKSHRSYSCQVTHEGSTVEKTVAPTECS
(SEQ ID NO: 271)

>EV1019-wt-BI2
MGWSCIILFLVATATGVHSQPALTQEASVSGTVGQTVTLLCSGNSSNIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 272)

>EV1019-wt-original-constant
MGWSCIILFLVATATGVHSQPALTQEASVSGTVGQTVTLLCSGNSSNIGSYAVGWYQQISRGAPKIVV
FGKSPASGIPDRFSGSKSGTTASLLVSGLQPEDEADYYCSTWDSRLSAVLFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 273)

>EV1019-N25S
MGWSCIILFLVATATGVHSQPALTQEASVSGTVGQTVTLLCSGSSSNIGSYAVGWYQQISRGAPKIVV
FGKSPASGIPDRFSGSKSGTTASLLVSGLQPEDEADYYCSTWDSRLSAVLFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 274)

>EV1019-N25S-BI2
MGWSCIILFLVATATGVHSQPALTQEASVSGTVGQTVTLLCSGSSSNIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 275)

>EV1019-N25G
MGWSCIILFLVATATGVHSQPALTQEASVSGTVGQTVTLLCSGGSSNIGSYAVGWYQQISRGAPKIVV
FGKSPASGIPDRFSGSKSGTTASLLVSGLQPEDEADYYCSTWDSRLSAVLFGGGTKLTVLRQPKAAPS

-continued

VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 276)

>EV1019-N25G-BI2
<u>MGWSCIILFLVATATGVHS</u>QPALTQEASVSGTVGQTVTLLCSGGSSNIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 277)

>EV1019-N25T
<u>MGWSCIILFLVATATGVHS</u>QPALTQEASVSGTVGQTVTLLCSGTSSNIGSYAVGWYQQISRGAPKIVV
FGKSPASGIPDRFSGSKSGTTASLLVSGLQPEDEADYYCSTWDSRLSAVLFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 278)

>EV1019-N25T-BI2
<u>MGWSCIILFLVATATGVHS</u>QPALTQEASVSGTVGQTVTLLCSGTSSNIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 279)

>EV1019-N25R
<u>MGWSCIILFLVATATGVHS</u>QPALTQEASVSGTVGQTVTLLCSGRSSNIGSYAVGWYQQISRGAPKIVV
FGKSPASGIPDRFSGSKSGTTASLLVSGLQPEDEADYYCSTWDSRLSAVLFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 280)

>EV1019-N25R-BI2
<u>MGWSCIILFLVATATGVHS</u>QPALTQEASVSGTVGQTVTLLCSGRSSNIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 281)

>EV1019-N25Q
<u>MGWSCIILFLVATATGVHS</u>QPALTQEASVSGTVGQTVTLLCSGQSSNIGSYAVGWYQQISRGAPKIVV
FGKSPASGIPDRFSGSKSGTTASLLVSGLQPEDEADYYCSTWDSRLSAVLFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 282)

>EV1019-N25Q-BI2
<u>MGWSCIILFLVATATGVHS</u>QPALTQEASVSGTVGQTVTLLCSGQSSNIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 283)

>EV1019-S27N
<u>MGWSCIILFLVATATGVHS</u>QPALTQEASVSGTVGQTVTLLCSGNSNNIGSYAVGWYQQISRGAPKIVV
FGKSPASGIPDRFSGSKSGTTASLLVSGLQPEDEADYYCSTWDSRLSAVLFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 284)

>EV1019-S27N-BI2
<u>MGWSCIILFLVATATGVHS</u>QPALTQEASVSGTVGQTVTLLCSGNSNNIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 285)

>EV1019-S27G
<u>MGWSCIILFLVATATGVHS</u>QPALTQEASVSGTVGQTVTLLCSGNSGNIGSYAVGWYQQISRGAPKIVV
FGKSPASGIPDRFSGSKSGTTASLLVSGLQPEDEADYYCSTWDSRLSAVLFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 286)

>EV1019-S27G-BI2
<u>MGWSCIILFLVATATGVHS</u>QPALTQEASVSGTVGQTVTLLCSGNSGNIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 287)

-continued

>EV1019-S27A
MGWSCIILFLVATATGVHSQPALTQEASVSGTVGQTVTLLCSGNSANIGSYAVGWYQQISRGAPKIVV
FGKSPASGIPDRFSGSKSGTTASLLVSGLQPEDEADYYCSTWDSRLSAVLFGGGTKLTVLRQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 288)

>EV1019-S27A-BI2
MGWSCIILFLVATATGVHSQPALTQEASVSGTVGQTVTLLCSGNSANIGSYAVGWYQQISRGAPKIVV
FGKSPASGIPDRFSGSKSGTTASLLVSGLQPEDEADYYCSTWDSRLSAVLFGGGTKLTVLGQPKAAPS
VTLFPPSSEELQANKATLVCLISDFYPGAVTVAWKADSSPVKAGVETTTPSKQSNNKYAASSYLSLTP
EQWKSHRSYSCQVTHEGSTVEKTVAPTECS
(SEQ ID NO: 289)

EV1019 Heavy Chains with Signal Sequence

>EV1019-IgG2
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTCDSWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 290)

>EV1019-wt-IgG4
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTCDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 291)

>EV1019-wt-IgG4SP
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTCDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 292)

>EV1019-C105G-IgG2
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTGDSWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 293)

>EV1019-C105G-IgG4
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTGDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 294)

>EV1019-C105G-IgG4SP
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTGDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 295)

>EV1019-C105S-IgG2
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTSDSWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT

-continued

PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 296)

>EV1019-C105S-IgG4
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTSDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 297)

>EV1019-C105S-IgG4SP
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTSDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 298)

>EV1019-C105A-IgG2
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTADSWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 299)

>EV1019-C105A-IgG4
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTADSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 300)

>EV1019-C105A-IgG4SP
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTADSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 301)

>EV1019-C105Q-IgG2
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTQDSWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 302)

>EV1019-C105Q-IgG4
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTQDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 303)

>EV1019-C105Q-IgG4SP
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTQDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV

-continued
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 304)

>EV1019-C105T-IgG2
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTTDSWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 305)

>EV1019-C105T-IgG4
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTTDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 306)

>EV1019-C105T-IgG4SP
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTTDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 307)

>EV1019-C105M-IgG2
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTMDSWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 308)

>EV1019-C105M-IgG4
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTMDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 309)

>EV1019-C105M-IgG4SP
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTMDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 310)

>EV1019-C105L-IgG2
MEFGLSWVFLAALLRGVQCQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTLDSWGQGTLVIVS
SASTKGPSVFPLAPCSRSTSESTAALGCLVKDYFPEPVTVSWNSGALTSGVHTFPAVLQSSGLYSLSS
VVTVPSSNFGTQTYTCNVDHKPSNTKVDKTVERKCCVECPPCPAPPVAGPSVFLFPPKPKDTLMISRT
PEVTCVVVDVSHEDPEVQFNWYVDGVEVHNAKTKPREEQFNSTFRVVSVLTVVHQDWLNGKEYKCKVS
NKGLPAPIEKTISKTKGQPREPQVYTLPPSREEMTKNQVSLTCLVKGFYPSDIAVEWESNGQPENNYK
TTPPMLDSDGSFFLYSKLTVDKSRWQQGNVFSCSVMHEALHNHYTQKSLSLSPGK
(SEQ ID NO: 311)

>EV1019-C105L-IgG4
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTLDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPSCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV

-continued

SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 312)

>EV1019-C105L-IgG4SP
MGWSCIILFLVATATGVHSQAQLVESGGGVVKPGGSLRLSCISSKFTFSSHAMHWVRQAPGKGLEWVA
VIWHDGSKKYYADSVKGRFSVSRDNSKNTLFLQMDSLRAEDTAVYFCGKEWVGGTLDSWGQGTLVIVS
SASTKGPSVFPLAPCSRSTSESTAALGCLVKDYFPEPVTVSWNSGALTSGVHTFPAVLQSSGLYSLSS
VVTVPSSSLGTKTYTCNVDHKPSNTKVDKRVESKYGPPCPPCPAPEFLGGPSVFLFPPKPKDTLMISR
TPEVTCVVVDVSQEDPEVQFNWYVDGVEVHNAKTKPREEQFNSTYRVVSVLTVLHQDWLNGKEYKCKV
SNKGLPSSIEKTISKAKGQPREPQVYTLPPSQEEMTKNQVSLTCLVKGFYPSDIAVEWESNGQPENNY
KTTPPVLDSDGSFFLYSRLTVDKSRWQEGNVFSCSVMHEALHNHYTQKSLSLSLGK
(SEQ ID NO: 313)

Consensus Sequences for EV1018 and EV1019

>$V_H$-CDR1
FTFS$X_1X_2$MH
$X_1$ is Y or H, and $X_2$ is G or A
(SEQ ID NO: 314)

>$V_H$-CDR2
$X_3X_4X_5$H$X_n$G$X_n X_6$K$X_7$YADSV$X_8$G
each $X_n$ independently is any naturally occurring amino acid, $X_3$ is L or V, $X_4$ is T or I, $X_5$ is Y or W, $X_6$ is R or K, $X_7$ is F or Y, and $X_8$ is R or K
(SEQ ID NO: 315)

>$V_H$-CDR3
E$X_n X_9$G$X_{10} X_n X_n$D$X_n$
each $X_n$ independently is any naturally occurring amino acid, $X_9$ is M or V, and $X_{10}$ is A or G
(SEQ ID NO: 316)

>$V_L$-CDR1
$X_n$GN$X_n X_n$NIGS$X_{11}$AVG
each $X_n$ independently is any naturally occurring amino acid, and $X_{11}$ is H or Y
(SEQ ID NO: 317)

>$V_L$-CDR2
G$X_{12}$SP$X_{13}$SG
$X_{12}$ is R or K, and $X_{13}$ is A or P
(SEQ ID NO: 318)

>$V_L$-CDR3
STWDS$X_{14}$LSAV$X_{15}$
$X_{14}$ is R or S, and $X_{15}$ is V or L
(SEQ ID NO: 319)

EV1003 and EV1007 Sequences

>EV1003 Heavy Chain (IgG1)
MDWTWRILFLVAAATGARSLVQLVQSEAEVKKPGASVRISCRTSGYIFPTFALHWVRQAPGQSLEWVG
SINTASGKTKFSTKFQDRLTLSSNTSATTVYMDLSGLTLDDTALYYCARDRFQNIMATILDVWGQGTL
VTVSSASTKGPSVFPLAPSSKSTSGGTAALGCLVKDYFPEPVTVSWNSGALTSGVHTFPAVLQSSGLY
SLSSVVTVPSSSLGTQTYICNVNHKPSNTKVDKKVEPKSCDKTHTCPPCPAPELLGGPSVFLFPPKPK
DTLMISRTPEVTCVVVDVSHEDPEVKFNWYVDGVEVHNAKTKPREEQYNSTYRVVSVLTVLHQDWLNG
KEYKCKVSNKALPAPIEKTISKAKGQPREPQVYTLPPSRDELTKNQVSLTCLVKGFYPSDIAVEWESN
GQPENNYKTTPPVLDSDGSFFLYSKLTVDKSRWQQGNVFSCSVMHEALHNHYTQKSLSLSPGK
(SEQ ID NO: 320)

>EV1003 Light Chain (Kappa)
METPAQLLFLLLLWLPGTTGDIVLTQSPGTLSLSPGERVTVSCRASHRVSSNYLAWYQQRPGQSPRLL
IFGASNRATGVPDRFSGSGSGTDFALTISRLEPDDFAVYYCQQYASSPVTFGGGTKLEIKRTVAAPSV
FIFPPSDEQLKSGTASVVCLLNNFYPREAKVQWKVDNALQSGNSQESVTEQDSKDSTYSLSSTLTLSK
ADYEKHKVYACEVTHQGLSSPVTKSFNRGEC
(SEQ ID NO: 321)

>EV1007 Heavy Chain (IgG1)
MDWTWRILFLVAAATGAPSQVHLVQSGSELKKPGASVKVSCKASGYSFSRYGIKWVRQAPGQGLEWMG
WINTRSGVPAYAQGFTGRFVFSLDTSVDTAFLEISSLKTEDTGIYYCATRPPRFYDKTEYWEDGFDVW
GRGTLVTVSSASTKGPSVFPLAPSSKSTSGGTAALGCLVKDYFPEPVTVSWNSGALTSGVHTFPAVLQ
SSGLYSLSSVVTVPSSSLGTQTYICNVNHKPSNTKVDKKVEPKSCDKTHTCPPCPAPELLGGPSVFLF
PPKPKDTLMISRTPEVTCVVVDVSHEDPEVKFNWYVDGVEVHNAKTKPREEQYNSTYRVVSVLTVLHQ
DWLNGKEYKCKVSNKALPAPIEKTISKAKGQPREPQVYTLPPSRDELTKNQVSLTCLVKGFYPSDIAV
EWESNGQPENNYKTTPPVLDSDGSFFLYSKLTVDKSRWQQGNVFSCSVMHEGLHNHYTQKSLSLSPGK
(SEQ ID NO: 322)

>EV1007 Light Chain (Lambda)
MAGFPLLLTLLTHCAGSWAQSVLTQPPSASGTPGQSVNISCSGSSSNIGNSYVYWYQQLPGTAPKLLI -continued YRNNRRPSGVPDRFSGSKSDTSASLAISGLRSEDEADYYCATWDDSLSGRLFGGGTKLTVLGQPKAAP
SVTLFPPSSEELQANKATLVCLISDFYPGAVTVAWKADGSPVKAGVETTTPSKQSNNKYAASSYLSLT
PEQWKSHRSYSCQVTHEGSTVEMTVAPTECS
(SEQ ID NO: 323)

Signal Sequences and Further Sequences

>EV1018
MEFGLIWVFLVTLLRGVQC
(SEQ ID NO: 324)

>EV1018-wt IgG1KO
MGWSCIILFLVATATGVHS
(SEQ ID NO: 325)

>EV1018 wt-original
MAWTPLLLQLLTLCSGSWA
(SEQ ID NO: 326)

TGTSSDVENYNLVS
(SEQ ID NO: 327)

EGSKRPS
(SEQ ID NO: 328)

CSYAGSSVVV
(SEQ ID NO: 329)

SGNSSNIGSYAVG
(SEQ ID NO: 330)

GKSPAS
(SEQ ID NO: 331)

STWDSRLSAVL
(SEQ ID NO: 332)

SHAMH
(SEQ ID NO: 333)

VIWHDGSKKYYADSVKG
(SEQ ID NO: 334)

EWVGGTCDS
(SEQ ID NO: 335)

SGSSSNIGNSYVY
(SEQ ID NO: 336)

RNNRRPS
(SEQ ID NO: 337)

ATWDDSLSGRL
(SEQ ID NO: 338)

RYGIK
(SEQ ID NO: 339)

WINTRSGVPAYAQGFTG
(SEQ ID NO: 340)

RPPRFYDKTEYWEDGFDV
(SEQ ID NO: 341)

RASHRVSSNYLA
(SEQ ID NO: 342)

GASNRAT
(SEQ ID NO: 343)

QQYASSPVT
(SEQ ID NO: 344)

TFALH
(SEQ ID NO: 345)

-continued

SINTASGKTKFSTKFQD
(SEQ ID NO: 346)

DRFQNIMATILDV
(SEQ ID NO: 347)

EV1018 Heavy Chain Variable Regions

>EV1018-VH
QVQLVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSS
(SEQ ID NO: 348)

>EV1018-VH-wt
QVELVESGGGMVQPGMPLRLSCVASGFTFSSYGMHWVRQAPGKGLEWVALTYHHGNRKFYADSVRGRF
TISRDNSNNTLYLQMTSLRAEDTAVYFCARESMGAINDNWGQGTLVIVSS
(SEQ ID NO: 349)

>EV1018-VH-T97A
QVELVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSS
(SEQ ID NO: 350)

>EV1018-VH-T97V
QVELVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSS
(SEQ ID NO: 351)

>EV1018-VH-N95D
QVELVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSS
(SEQ ID NO: 352)

>EV1018-VH-N95E
QVELVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSS
(SEQ ID NO: 353)

>EV1018-VH-N95K
QVELVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSS
(SEQ ID NO: 354)

>EV1018-VH-N95Q
QVELVESGGGMVQPGMPLRLSCVASGFTFSSYGMHWVRQAPGKGLEWVALTYHHGNRKFYADSVRGRF
TISRDNSQNTLYLQMTSLRAEDTAVYFCARESMGAINDNWGQGTLVIVSS
(SEQ ID NO: 355)

>EV1018-VH-N93Q-N95T
QVELVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSS
(SEQ ID NO: 356)

>EV1018-VH-T97A IgG1-original-constant
QVQLVESGGGMVQPGMPLRLSCVASGFTFSSYGMHWVRQAPGKGLEWVALTYHHGNRKFYADSVRGRF
TISRDNSNNALYLQMTSLRAEDTAVYFCARESMGAINDNWGQGTLVIVSS
(SEQ ID NO: 357)

>EV1018-VH-T97V IgG1-original-constant
QVQLVESGGGMVQPGMPLRLSCVASGFTFSSYGMHWVRQAPGKGLEWVALTYHHGNRKFYADSVRGRF
TISRDNSNNVLYLQMTSLRAEDTAVYFCARESMGAINDNWGQGTLVIVSS
(SEQ ID NO: 358)

>EV1018-VH-N95D IgG1-original-constant
QVQLVESGGGMVQPGMPLRLSCVASGFTFSSYGMHWVRQAPGKGLEWVALTYHHGNRKFYADSVRGRF
TISRDNSDNTLYLQMTSLRAEDTAVYFCARESMGAINDNWGQGTLVIVSS
(SEQ ID NO: 359)

>EV1018-VH-N95E IgG1-original-constant
QVQLVESGGGMVQPGMPLRLSCVASGFTFSSYGMHWVRQAPGKGLEWVALTYHHGNRKFYADSVRGRF
TISRDNSENTLYLQMTSLRAEDTAVYFCARESMGAINDNWGQGTLVIVSS
(SEQ ID NO: 360)

>EV1018-VH-N95K IgG1-original-constant
QVQLVESGGGMVQPGMPLRLSCVASGFTFSSYGMHWVRQAPGKGLEWVALTYHHGNRKFYADSVRGRF
TISRDNSKNTLYLQMTSLRAEDTAVYFCARESMGAINDNWGQGTLVIVSS
(SEQ ID NO: 361)

>EV1018-VH-N95Q IgG1-original-constant
QVQLVESGGGMVQPGMPLRLSCVASGFTFSSYGMHWVRQAPGKGLEWVALTYHHGNRKFYADSVRGRF -continued

```
TISRDNSQNTLYLQMTSLRAEDTAVYFCARESMGAINDNWGQGTLVIVSS
(SEQ ID NO: 362)

>EV1018-VH-N93Q-N95T IgG1-original-constant
QVQLVESGGGMVQPGMPLRLSCVASGFTFSSYGMHWVRQAPGKGLEWVALTYHHGNRKFYADSVRGRF
TISRDQSTNTLYLQMTSLRAEDTAVYFCARESMGAINDNWGQGTLVIVSS
(SEQ ID NO: 363)

EV1018 Light Chain Variable Regions

>EV1018-VL-wt-original
QSALTQETSVSGTVGQKVTLSCIGNNNNIGSHAVGWYQQISRGAPKMVLFGRSPPSGVPDRFSGSKSG
TTASLIISGLQPEDEADYYCSTWDSSLSAVVFGGGTKLTVLR
(SEQ ID NO: 364)

>EV1018-VL-wt-BI
QSALTQETSVSGTVGQKVTLSCIGNNNNIGSHAVGWYQQISRGAPKMVLFGRSPPSGVPDRFSGSKSG
TTASLIISGLQPEDEADYYCSTWDSSLSAVVFGGGTKLTVLG
(SEQ ID NO: 365)
```

SEQUENCE LISTING (365 sequences)

SEQ ID NO: 1 - protein, 144 aa, Homo sapiens
MWLQSLLLLGTVACSISAPARSPSPSTQPWEHVNAIQEARRLLNLSRDTAAEMNETVEVISEMFDLQEPTCLQTRLELYKQGLRGSLTKLKGPLTMMASHYKQHCPPTPETSCATQIITFESFKENLKDFLLVIPFDCWEPVQE

SEQ ID NO: 2 - protein, 4 aa, Homo sapiens
ELYK

SEQ ID NO: 3 - protein, 10 aa, Homo sapiens
TMMASHYKQH

SEQ ID NO: 4 - protein, 5 aa, Homo sapiens
SYGMH

SEQ ID NO: 5 - protein, 17 aa, Homo sapiens
LTYHHGNRKFYADSVRG

SEQ ID NO: 6 - protein, 9 aa, Homo sapiens
ESMGAINDN

SEQ ID NO: 7 - protein, 13 aa, Homo sapiens
IGNNNNIGSHAVG

SEQ ID NO: 8 - protein, 6 aa, Homo sapiens
GRSPPS

SEQ ID NO: 9 - protein, 11 aa, Homo sapiens
STWDSSLSAVV

SEQ ID NO: 10 - protein, 448 aa, Homo sapiens
QVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - protein, 448 aa, Homo sapiens
QVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 448 aa, Homo sapiens
QVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - protein, 448 aa, Homo sapiens
QVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14 - protein, 448 aa, Homo sapiens
QVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15 - protein, 448 aa, Homo sapiens
QVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - protein, 448 aa, Homo sapiens
QVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - protein, 448 aa, Homo sapiens
QVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 448 aa, Homo sapiens
QVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - protein, 448 aa, Homo sapiens
QVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 448 aa, Homo sapiens
QVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - protein, 448 aa, Homo sapiens
QVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 448 aa, Homo sapiens
QVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 448 aa, Homo sapiens
QVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 448 aa, Homo sapiens
QVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - protein, 448 aa, Homo sapiens
QVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 448 aa, Homo sapiens
QVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 448 aa, Homo sapiens
QVQLVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 448 aa, Homo sapiens
QVQLVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 448 aa, Homo sapiens
QVQLVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 448 aa, Homo sapiens
QVQLVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 448 aa, Homo sapiens
QVQLVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 448 aa, Homo sapiens
QVQLVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - protein, 448 aa, Homo sapiens
QVQLVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 215 aa, Homo sapiens
QSALTQETSVSGTVGQKVTLSCIGNNNNIGSHAVGWYQQISRGAPKMVLFGRSPPSGVPDRFSGSKSGTTASLIISGLQPEDEADYYCSTWDSSLSAVVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 35 - protein, 215 aa, Homo sapiens
QSALTQETSVSGTVGQKVTLSCIGNNNNIGSHAVGWYQQISRGAPKMVLFGRSPPSGVPDRFSGSKSGTTASLIISGLQPEDEADYYCSTWDSSLSAVVFGGGTKLTVLGQPKAAPSVTLFPPSSEELQANKATLVCLISDFYPGAVTVAWKGDSSPVKAGVETTTPSKQSNNKYAASSYLSLTPEQWKSHRSYSCQVTHEGSTVEKTVAPTECS

SEQ ID NO: 36 - protein, 215 aa, Homo sapiens
QSALTQETSVSGTVGQKVTLSCIGNNNNIGSHAVGWYQQISRGAPKMVLFGRSPPSGVPDRFSGSKSGTTASLIISGLQPEDEADYYCSTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 37 - protein, 215 aa, Homo sapiens; identical to SEQ ID NO: 34

SEQ ID NO: 38 - protein, 448 aa, Homo sapiens
QVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - protein, 448 aa, Homo sapiens
QVQLVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 448 aa, Homo sapiens
QVQLVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - protein, 448 aa, Homo sapiens
QVQLVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 448 aa, Homo sapiens
QVQLVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - protein, 448 aa, Homo sapiens
QVQLVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 448 aa, Homo sapiens
QVQLVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 45 - protein, 448 aa, Homo sapiens
QVQLVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 448 aa, Homo sapiens
QVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 448 aa, Homo sapiens
QVQLVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 448 aa, Homo sapiens
QVQLVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 448 aa, Homo sapiens
QVQLVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 448 aa, Homo sapiens
QVQLVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - protein, 448 aa, Homo sapiens
QVQLVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 448 aa, Homo sapiens
QVQLVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 448 aa, Homo sapiens
QVQLVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 444 aa, Homo sapiens
QVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 55 - protein, 444 aa, Homo sapiens
QVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 56 - protein, 444 aa, Homo sapiens
QVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 57 - protein, 444 aa, Homo sapiens
QVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 58 - protein, 444 aa, Homo sapiens
QVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 59 - protein, 444 aa, Homo sapiens
QVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 60 - protein, 444 aa, Homo sapiens
QVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 61 - protein, 444 aa, Homo sapiens
QVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 62 - protein, 444 aa, Homo sapiens
QVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 63 - protein, 445 aa, Homo sapiens
QVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 64 - protein, 445 aa, Homo sapiens
QVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 65 - protein, 445 aa, Homo sapiens
QVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 66 - protein, 445 aa, Homo sapiens
QVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 67 - protein, 445 aa, Homo sapiens
QVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 68 - protein, 445 aa, Homo sapiens
QVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 69 - protein, 445 aa, Homo sapiens
QVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 70 - protein, 445 aa, Homo sapiens
QVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 71 - protein, 445 aa, Homo sapiens
QVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 72 - protein, 445 aa, Homo sapiens
QVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 73 - protein, 445 aa, Homo sapiens
QVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 74 - protein, 445 aa, Homo sapiens
QVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 75 - protein, 445 aa, Homo sapiens
QVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 76 - protein, 445 aa, Homo sapiens
QVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 77 - protein, 445 aa, Homo sapiens
QVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 78 - protein, 445 aa, Homo sapiens
QVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 79 - protein, 445 aa, Homo sapiens
QVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 80 - protein, 445 aa, Homo sapiens
QVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 81 - protein, 467 aa, Homo sapiens
MEFGLIWVFLVTLLRGVQCQVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 467 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 234 aa, Homo sapiens
MAWTPLLLQLLTLCSGSWAQSALTQETSVSGTVGQKVTLSCIGNNNNIGSHAVGWYQQISRGAPKMVLFGRSPPSGVPDRFSGSKSGTTASLIISGLQPEDEADYYCSTWDSSLSAVVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 106 - protein, 234 aa, Homo sapiens
MGWSCIILFLVATATGVHSQSALTQETSVSGTVGQKVTLSCIGNNNNIGSHAVGWYQQISRGAPKMVLFGRSPPSGVPDRFSGSKSGTTASLIISGLQPEDEADYYCSTWDSSLSAVVFGGGTKLTVLGQPKAAPSVTLFPPSSEELQANKATLVCLISDFYPGAVTVAWKGDSSPVKAGVETTTPSKQSNNKYAASSYLSLTPEQWKSHRSYSCQVTHEGSTVEKTVAPTECS

SEQ ID NO: 107 - protein, 234 aa, Homo sapiens
MGWSCIILFLVATATGVHSQSALTQETSVSGTVGQKVTLSCIGNNNNIGSHAVGWYQQISRGAPKMVLFGRSPPSGVPDRFSGSKSGTTASLIISGLQPEDEADYYCSTWDSSLSAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 108 - protein, 234 aa, Homo sapiens
MGWSCIILFLVATATGVHSQSALTQETSVSGTVGQKVTLSCIGNNNNIGSHAVGWYQQISRGAPKMVLFGRSPPSGVPDRFSGSKSGTTASLIISGLQPEDEADYYCSTWDSSLSAVVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 109 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 115 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 467 aa, Homo sapiens
MGWSCIILFLVATATGVHSQVQLVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 463 aa, Homo sapiens
MEFGLIWVFLVTLLRGVQCQVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 126 - protein, 463 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 127 - protein, 463 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 128 - protein, 463 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 129 - protein, 463 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 130 - protein, 463 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 131 - protein, 463 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 132 - protein, 463 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 133 - protein, 463 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 134 - protein, 464 aa, Homo sapiens
MEFGLIWVFLVTLLRGVQCQVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 135 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 136 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 137 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 138 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 139 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 140 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 141 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 142 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 143 - protein, 464 aa, Homo sapiens
MEFGLIWVFLVTLLRGVQCQVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 144 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 145 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 146 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 147 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 148 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 149 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 150 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 151 - protein, 464 aa, Homo sapiens
MGWSCIILFLVATATGVHSQVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 152 - protein, 118 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSS

SEQ ID NO: 153 - protein, 118 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSS

SEQ ID NO: 154 - protein, 118 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSS

SEQ ID NO: 155 - protein, 118 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSS

SEQ ID NO: 156 - protein, 118 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSS

SEQ ID NO: 157 - protein, 118 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSS

SEQ ID NO: 158 - protein, 118 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSS

SEQ ID NO: 159 - protein, 118 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSS

SEQ ID NO: 160 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 166 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 175 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 179 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 448 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 110 aa, Homo sapiens
QPALTQEASVSGTVGQTVTLLCSGNSSNIGSYAVGWYQQISRGAPKIVVFGKSPASGIPDRFSGSKSGTTASLLVSGLQPEDEADYYCSTWDSRLSAVLFGGGTKLTVLR

SEQ ID NO: 185 - protein, 110 aa, Homo sapiens
QPALTQEASVSGTVGQTVTLLCSGNSSNIGSYAVGWYQQISRGAPKIVVFGKSPASGIPDRFSGSKSGTTASLLVSGLQPEDEADYYCSTWDSRLSAVLFGGGTKLTVLG

SEQ ID NO: 186 - protein, 110 aa, Homo sapiens
QPALTQEASVSGTVGQTVTLLCSGSSSNIGSYAVGWYQQISRGAPKIVVFGKSPASGIPDRFSGSKSGTTASLLVSGLQPEDEADYYCSTWDSRLSAVLFGGGTKLTVLR

SEQ ID NO: 187 - protein, 110 aa, Homo sapiens
QPALTQEASVSGTVGQTVTLLCSGSSSNIGSYAVGWYQQISRGAPKIVVFGKSPASGIPDRFSGSKSGTTASLLVSGLQPEDEADYYCSTWDSRLSAVLFGGGTKLTVLG

SEQ ID NO: 188 - protein, 110 aa, Homo sapiens
QPALTQEASVSGTVGQTVTLLCSGGSSNIGSYAVGWYQQISRGAPKIVVFGKSPASGIPDRFSGSKSGTTASLLVSGLQPEDEADYYCSTWDSRLSAVLFGGGTKLTVLR

SEQ ID NO: 189 - protein, 110 aa, Homo sapiens
QPALTQEASVSGTVGQTVTLLCSGGSSNIGSYAVGWYQQISRGAPKIVVFGKSPASGIPDRFSGSKSGTTASLLVSGLQPEDEADYYCSTWDSRLSAVLFGGGTKLTVLG

SEQ ID NO: 190 - protein, 110 aa, Homo sapiens
QPALTQEASVSGTVGQTVTLLCSGTSSNIGSYAVGWYQQISRGAPKIVVFGKSPASGIPDRFSGSKSGTTASLLVSGLQPEDEADYYCSTWDSRLSAVLFGGGTKLTVLR

SEQ ID NO: 191 - protein, 110 aa, Homo sapiens
QPALTQEASVSGTVGQTVTLLCSGTSSNIGSYAVGWYQQISRGAPKIVVFGKSPASGIPDRFSGSKSGTTASLLVSGLQPEDEADYYCSTWDSRLSAVLFGGGTKLTVLG

SEQ ID NO: 192 - protein, 110 aa, Homo sapiens
QPALTQEASVSGTVGQTVTLLCSGRSSNIGSYAVGWYQQISRGAPKIVVFGKSPASGIPDRFSGSKSGTTASLLVSGLQPEDEADYYCSTWDSRLSAVLFGGGTKLTVLR

SEQ ID NO: 193 - protein, 110 aa, Homo sapiens
QPALTQEASVSGTVGQTVTLLCSGRSSNIGSYAVGWYQQISRGAPKIVVFGKSPASGIPDRFSGSKSGTTASLLVSGLQPEDEADYYCSTWDSRLSAVLFGGGTKLTVLG

SEQ ID NO: 194 - protein, 110 aa, Homo sapiens
QPALTQEASVSGTVGQTVTLLCSGQSSNIGSYAVGWYQQISRGAPKIVVFGKSPASGIPDRFSGSKSGTTASLLVSGLQPEDEADYYCSTWDSRLSAVLFGGGTKLTVLR

SEQ ID NO: 195 - protein, 110 aa, Homo sapiens
QPALTQEASVSGTVGQTVTLLCSGQSSNIGSYAVGWYQQISRGAPKIVVFGKSPASGIPDRFSGSKSGTTASLLVSGLQPEDEADYYCSTWDSRLSAVLFGGGTKLTVLG

SEQ ID NO: 196 - protein, 110 aa, Homo sapiens
QPALTQEASVSGTVGQTVTLLCSGNSNNIGSYAVGWYQQISRGAPKIVVFGKSPASGIPDRFSGSKSGTTASLLVSGLQPEDEADYYCSTWDSRLSAVLFGGGTKLTVLR

SEQ ID NO: 197 - protein, 110 aa, Homo sapiens
QPALTQEASVSGTVGQTVTLLCSGNSNNIGSYAVGWYQQISRGAPKIVVFGKSPASGIPDRFSGSKSGTTASLLVSGLQPEDEADYYCSTWDSRLSAVLFGGGTKLTVLG

SEQ ID NO: 198 - protein, 110 aa, Homo sapiens
QPALTQEASVSGTVGQTVTLLCSGNSGNIGSYAVGWYQQISRGAPKIVVFGKSPASGIPDRFSGSKSGTTASLLVSGLQPEDEADYYCSTWDSRLSAVLFGGGTKLTVLR

SEQ ID NO: 199 - protein, 110 aa, Homo sapiens
QPALTQEASVSGTVGQTVTLLCSGNSGNIGSYAVGWYQQISRGAPKIVVFGKSPASGIPDRFSGSKSGTTASLLVSGLQPEDEADYYCSTWDSRLSAVLFGGGTKLTVLG

SEQ ID NO: 200 - protein, 110 aa, Homo sapiens
QPALTQEASVSGTVGQTVTLLCSGNSANIGSYAVGWYQQISRGAPKIVVFGKSPASGIPDRFSGSKSGTTASLLVSGLQPEDEADYYCSTWDSRLSAVLFGGGTKLTVLR

SEQ ID NO: 201 - protein, 110 aa, Homo sapiens
QPALTQEASVSGTVGQTVTLLCSGNSANIGSYAVGWYQQISRGAPKIVVFGKSPASGIPDRFSGSKSGTTASLLVSGLQPEDEADYYCSTWDSRLSAVLFGGGTKLTVLG

SEQ ID NO: 202 - protein, 215 aa, Homo sapiens
QPALTQEASVSGTVGQTVTLLCSGNSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 203 - protein, 215 aa, Homo sapiens
QPALTQEASVSGTVGQTVTLLCSGNSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKGDSSPVKAGVETTTPSKQSNNKYAASSYLSLTPEQWKSHRSYSCQVTHEGSTVEKTVAPTECS

SEQ ID NO: 204 - protein, 215 aa, Homo sapiens
QPALTQEASVSGTVGQTVTLLCSGNSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 205 - protein, 215 aa, Homo sapiens; identical to SEQ ID NO: 202

SEQ ID NO: 206 - protein, 215 aa, Homo sapiens
QPALTQEASVSGTVGQTVTLLCSGSSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 207 - protein, 215 aa, Homo sapiens
QPALTQEASVSGTVGQTVTLLCSGSSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 208 - protein, 215 aa, Homo sapiens
QPALTQEASVSGTVGQTVTLLCSGGSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 209 - protein, 215 aa, Homo sapiens
QPALTQEASVSGTVGQTVTLLCSGGSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 210 - protein, 215 aa, Homo sapiens
QPALTQEASVSGTVGQTVTLLCSGTSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 211 - protein, 215 aa, Homo sapiens
QPALTQEASVSGTVGQTVTLLCSGTSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 212 - protein, 215 aa, Homo sapiens
QPALTQEASVSGTVGQTVTLLCSGRSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 213 - protein, 215 aa, Homo sapiens
QPALTQEASVSGTVGQTVTLLCSGRSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 214 - protein, 215 aa, Homo sapiens
QPALTQEASVSGTVGQTVTLLCSGQSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 215 - protein, 215 aa, Homo sapiens
QPALTQEASVSGTVGQTVTLLCSGQSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 216 - protein, 215 aa, Homo sapiens
QPALTQEASVSGTVGQTVTLLCSGNSNNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 217 - protein, 215 aa, Homo sapiens
QPALTQEASVSGTVGQTVTLLCSGNSNNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 218 - protein, 215 aa, Homo sapiens
QPALTQEASVSGTVGQTVTLLCSGNSGNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 219 - protein, 215 aa, Homo sapiens
QPALTQEASVSGTVGQTVTLLCSGNSGNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 220 - protein, 215 aa, Homo sapiens
QPALTQEASVSGTVGQTVTLLCSGNSANIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 221 - protein, 215 aa, Homo sapiens
QPALTQEASVSGTVGQTVTLLCSGNSANIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 222 - protein, 444 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 223 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 224 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 225 - protein, 444 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 226 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 227 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 228 - protein, 444 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 229 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 230 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 231 - protein, 444 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 232 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 233 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 234 - protein, 444 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 235 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 236 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 237 - protein, 444 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 238 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 239 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 240 - protein, 444 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 241 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 242 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 243 - protein, 444 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 244 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 245 - protein, 445 aa, Homo sapiens
QAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 246 - protein, 467 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 248 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 249 - protein, 467 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 250 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 252 - protein, 467 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 255 - protein, 467 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 257 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - protein, 467 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 259 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 260 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 261 - protein, 467 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 263 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 264 - protein, 467 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 265 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 266 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - protein, 467 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 268 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 269 - protein, 467 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - protein, 234 aa, Homo sapiens
MAWTPLLLQLLTLCSGSWAQPALTQEASVSGTVGQTVTLLCSGNSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 271 - protein, 234 aa, Homo sapiens
MGWSCIILFLVATATGVHSQPALTQEASVSGTVGQTVTLLCSGNSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKGDSSPVKAGVETTTPSKQSNNKYAASSYLSLTPEQWKSHRSYSCQVTHEGSTVEKTVAPTECS

SEQ ID NO: 272 - protein, 234 aa, Homo sapiens
MGWSCIILFLVATATGVHSQPALTQEASVSGTVGQTVTLLCSGNSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 273 - protein, 234 aa, Homo sapiens
MGWSCIILFLVATATGVHSQPALTQEASVSGTVGQTVTLLCSGNSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 274 - protein, 234 aa, Homo sapiens
MGWSCIILFLVATATGVHSQPALTQEASVSGTVGQTVTLLCSGSSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 275 - protein, 234 aa, Homo sapiens
MGWSCIILFLVATATGVHSQPALTQEASVSGTVGQTVTLLCSGSSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 276 - protein, 234 aa, Homo sapiens
MGWSCIILFLVATATGVHSQPALTQEASVSGTVGQTVTLLCSGGSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 277 - protein, 234 aa, Homo sapiens
MGWSCIILFLVATATGVHSQPALTQEASVSGTVGQTVTLLCSGGSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 278 - protein, 234 aa, Homo sapiens
MGWSCIILFLVATATGVHSQPALTQEASVSGTVGQTVTLLCSGTSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 279 - protein, 234 aa, Homo sapiens
MGWSCIILFLVATATGVHSQPALTQEASVSGTVGQTVTLLCSGTSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 280 - protein, 234 aa, Homo sapiens
MGWSCIILFLVATATGVHSQPALTQEASVSGTVGQTVTLLCSGRSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 281 - protein, 234 aa, Homo sapiens
MGWSCIILFLVATATGVHSQPALTQEASVSGTVGQTVTLLCSGRSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 282 - protein, 234 aa, Homo sapiens
MGWSCIILFLVATATGVHSQPALTQEASVSGTVGQTVTLLCSGQSSNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 283 - protein, 234 aa, Homo sapiens
MGWSCIILFLVATATGVHSQPALTQEASVSGTVGQTVTLLCSGQSSNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 284 - protein, 234 aa, Homo sapiens
MGWSCIILFLVATATGVHSQPALTQEASVSGTVGQTVTLLCSGNSNNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 285 - protein, 234 aa, Homo sapiens
MGWSCIILFLVATATGVHSQPALTQEASVSGTVGQTVTLLCSGNSNNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 286 - protein, 234 aa, Homo sapiens
MGWSCIILFLVATATGVHSQPALTQEASVSGTVGQTVTLLCSGNSGNIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 287 - protein, 234 aa, Homo sapiens
MGWSCIILFLVATATGVHSQPALTQEASVSGTVGQTVTLLCSGNSGNIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 288 - protein, 234 aa, Homo sapiens
MGWSCIILFLVATATGVHSQPALTQEASVSGTVGQTVTLLCSGNSANIGSYAVGWYQQISRGAPKIVVFGKSPASGIPDRFSGSKSGTTASLLVSGLQPEDEADYYCSTWDSRLSAVLFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 289 - protein, 234 aa, Homo sapiens
MGWSCIILFLVATATGVHSQPALTQEASVSGTVGQTVTLLCSGNSANIGSYAVGWYQQISRGAPKIVVFGKSPASGIPDRFSGSKSGTTASLLVSGLQPEDEADYYCSTWDSRLSAVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 290 - protein, 463 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 291 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 292 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTCDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 293 - protein, 463 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 294 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 295 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTGDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 296 - protein, 463 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 297 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 298 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTSDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 299 - protein, 463 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 300 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 301 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTADSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 302 - protein, 463 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 303 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 304 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTQDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 305 - protein, 463 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 306 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 307 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTTDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 308 - protein, 463 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 309 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 310 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTMDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 311 - protein, 463 aa, Homo sapiens
MEFGLSWVFLAALLRGVQCQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 312 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 313 - protein, 464 aa, Homo sapiens
MGWSCIILFLVATATGVHSQAQLVESGGGVVKPGGSLRLSCISSKFTFSSHAMHWVRQAPGKGLEWVAVIWHDGSKKYYADSVKGRFSVSRDNSKNTLFLQMDSLRAEDTAVYFCGKEWVGGTLDSWGQGTLVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 314 - protein, 8 aa, Homo sapiens
  MISC_FEATURE (5)..(5): Tyr or His
  MISC_FEATURE (6)..(6): Gly or Ala
FTFSXXMH

SEQ ID NO: 315 - protein, 17 aa, Homo sapiens
  MISC_FEATURE (1)..(1): Leu or Val
  MISC_FEATURE (2)..(2): Thr or Ile
  MISC_FEATURE (3)..(3): Tyr or Trp
  MISC_FEATURE (5)..(5): Any amino acid
  MISC_FEATURE (7)..(7): Any amino acid
  MISC_FEATURE (8)..(8): Arg or Lys
  MISC_FEATURE (10)..(10): Phe or Tyr
  MISC_FEATURE (16)..(16): Arg or Lys
XXXHXGXXKXYADSVXG

SEQ ID NO: 316 - protein, 9 aa, Homo sapiens
  MISC_FEATURE (2)..(2): Any amino acid
  MISC_FEATURE (3)..(3): Met or Val
  MISC_FEATURE (5)..(5): Ala or Gly
  MISC_FEATURE (6)..(6): Any amino acid
  MISC_FEATURE (7)..(7): Any amino acid
  MISC_FEATURE (9)..(9): Any amino acid
EXXGXXXDX

SEQ ID NO: 317 - protein, 13 aa, Homo sapiens
  MISC_FEATURE (1)..(1): Any amino acid
  MISC_FEATURE (4)..(4): Any amino acid
  MISC_FEATURE (5)..(5): Any amino acid
  MISC_FEATURE (10)..(10): His or Tyr
XGNXXNIGSXAVG

SEQ ID NO: 318 - protein, 7 aa, Homo sapiens
  MISC_FEATURE (2)..(2): R or K
  MISC_FEATURE (5)..(5): A or P
GXSPXSG

SEQ ID NO: 319 - protein, 11 aa, Homo sapiens
  MISC_FEATURE (6)..(6): Arg or Ser
  MISC_FEATURE (11)..(11): Val or Leu
STWDSXLSAVX

SEQ ID NO: 320 - protein, 471 aa, Homo sapiens
MDWTWRILFLVAAATGARSLVQLVQSEAEVKKPGASVRISCRTSGYIFPTFALHWVRQAPGQSLEWVGSINTASGKTKFSTKFQDRLTLSSNTSATTVYMDLSGLTLDDTALYYCARDRFQNIMATILDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 235 aa, Homo sapiens
METPAQLLFLLLLWLPGTTGDIVLTQSPGTLSLSPGERVTVSCRASHRVSSNYLAWYQQRPGQSPRLLIFGASNRATGVPDRFSGSGSGTDFALTISRLEPDDFAVYYCQQYASSPVTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 322 - protein, 476 aa, Homo sapiens
MDWTWRILFLVAAATGAPSQVHLVQSGSELKKPGASVKVSCKASGYSFSRYGIKWVRQAPGQGLEWMGWINTRSGVPAYAQGFTGRFVFSLDTSVDTAFLEISSLKTEDTGIYYCATRPPRFYDKTEYWEDGFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 323 - protein, 235 aa, Homo sapiens
MAGFPLLLTLLTHCAGSWAQSVLTQPPSASGTPGQSVNISCSGSSSNIGNSYVYWYQQLPGTAPKLLIYRNNRRPSGVPDRFSGSKSDTSASLAISGLRSEDEADYYCATWDDSLSGRLFGGGTKLTVLGQPKAAPSVTLFPPSSEELQANKATLVCLISDFYPGAVTVAWKADGSPVKAGVETTTPSKQSNNKYAASSYLSLTPEQWKSHRSYSCQVTHEGSTVEMTVAPTECS

SEQ ID NO: 324 - protein, 19 aa, Homo sapiens
MEFGLIWVFLVTLLRGVQC

SEQ ID NO: 325 - protein, 19 aa, Homo sapiens
MGWSCIILFLVATATGVHS

SEQ ID NO: 326 - protein, 19 aa, Homo sapiens
MAWTPLLLQLLTLCSGSWA

SEQ ID NO: 327 - protein, 14 aa, Homo sapiens
TGTSSDVENYNLVS

SEQ ID NO: 328 - protein, 7 aa, Homo sapiens
EGSKRPS

SEQ ID NO: 329 - protein, 10 aa, Homo sapiens
CSYAGSSVVV

SEQ ID NO: 330 - protein, 13 aa, Homo sapiens
SGNSSNIGSYAVG

SEQ ID NO: 331 - protein, 6 aa, Homo sapiens
GKSPAS

SEQ ID NO: 332 - protein, 11 aa, Homo sapiens
STWDSRLSAVL

SEQ ID NO: 333 - protein, 5 aa, Homo sapiens
SHAMH

SEQ ID NO: 334 - protein, 17 aa, Homo sapiens
VIWHDGSKKYYADSVKG

SEQ ID NO: 335 - protein, 9 aa, Homo sapiens
EWVGGTCDS

SEQ ID NO: 336 - protein, 13 aa, Homo sapiens
SGSSSNIGNSYVY

SEQ ID NO: 337 - protein, 7 aa, Homo sapiens
RNNRRPS

SEQ ID NO: 338 - protein, 11 aa, Homo sapiens
ATWDDSLSGRL

SEQ ID NO: 339 - protein, 5 aa, Homo sapiens
RYGIK

SEQ ID NO: 340 - protein, 17 aa, Homo sapiens
WINTRSGVPAYAQGFTG

SEQ ID NO: 341 - protein, 18 aa, Homo sapiens
RPPRFYDKTEYWEDGFDV

SEQ ID NO: 342 - protein, 12 aa, Homo sapiens
RASHRVSSNYLA

SEQ ID NO: 343 - protein, 7 aa, Homo sapiens
GASNRAT

SEQ ID NO: 344 - protein, 9 aa, Homo sapiens
QQYASSPVT

SEQ ID NO: 345 - protein, 5 aa, Homo sapiens
TFALH

SEQ ID NO: 346 - protein, 17 aa, Homo sapiens
SINTASGKTKFSTKFQD

SEQ ID NO: 347 - protein, 13 aa, Homo sapiens
DRFQNIMATILDV

SEQ ID NO: 348 - protein, 118 aa, Homo sapiens
QVQLVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSS

SEQ ID NO: 349 - protein, 118 aa, Homo sapiens
QVELVESGGGMVQPGMPLRLSCVASGFTFSSYGMHWVRQAPGKGLEWVALTYHHGNRKFYADSVRGRFTISRDNSNNTLYLQMTSLRAEDTAVYFCARESMGAINDNWGQGTLVIVSS

SEQ ID NO: 350 - protein, 118 aa, Homo sapiens
QVELVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSS

SEQ ID NO: 351 - protein, 118 aa, Homo sapiens
QVELVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSS

SEQ ID NO: 352 - protein, 118 aa, Homo sapiens
QVELVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSS

SEQ ID NO: 353 - protein, 118 aa, Homo sapiens
QVELVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSS

SEQ ID NO: 354 - protein, 118 aa, Homo sapiens
QVELVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSS

SEQ ID NO: 355 - protein, 118 aa, Homo sapiens
QVELVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSS

SEQ ID NO: 356 - protein, 118 aa, Homo sapiens
QVELVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSS

SEQ ID NO: 357 - protein, 118 aa, Homo sapiens
QVQLVESGGGMVQPGMPLRLSCVASGFTFSSYGMHWVRQAPGKGLEWVALTYHHGNRKFYADSVRGRFTISRDNSNNALYLQMTSLRAEDTAVYFCARESMGAINDNWGQGTLVIVSS

SEQ ID NO: 358 - protein, 118 aa, Homo sapiens
QVQLVESGGGMVQPGMPLRLSCVASGFTFSSYGMHWVRQAPGKGLEWVALTYHHGNRKFYADSVRGRFTISRDNSNNVLYLQMTSLRAEDTAVYFCARESMGAINDNWGQGTLVIVSS

SEQ ID NO: 359 - protein, 118 aa, Homo sapiens
QVQLVESGGGMVQPGMPLRLSCVASGFTFSSYGMHWVRQAPGKGLEWVALTYHHGNRKFYADSVRGRFTISRDNSDNTLYLQMTSLRAEDTAVYFCARESMGAINDNWGQGTLVIVSS

SEQ ID NO: 360 - protein, 118 aa, Homo sapiens
QVQLVESGGGMVQPGMPLRLSCVASGFTFSSYGMHWVRQAPGKGLEWVALTYHHGNRKFYADSVRGRFTISRDNSENTLYLQMTSLRAEDTAVYFCARESMGAINDNWGQGTLVIVSS

SEQ ID NO: 361 - protein, 236 aa, Homo sapiens
QVQLVESGGGMVQPGMPLRLSCVASGFTFSSYGMHWVRQAPGKGLEWVALTYHHGNRKFYADSVRGRFTISRDNSKNTLYLQMTSLRAEDTAVYFCARESMGAINDNWGQGTLVIVSSQVQLVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSS

SEQ ID NO: 362 - protein, 118 aa, Homo sapiens
QVQLVESGGGMVQPGMPLRLSCVASGFTFSSYGMHWVRQAPGKGLEWVALTYHHGNRKFYADSVRGRFTISRDNSQNTLYLQMTSLRAEDTAVYFCARESMGAINDNWGQGTLVIVSS

SEQ ID NO: 363 - protein, 118 aa, Homo sapiens
QVQLVESGGGMVQPGMPLRLSCVASGFTFSSYGMHWVRQAPGKGLEWVALTYHHGNRKFYADSVRGRFTISRDQSTNTLYLQMTSLRAEDTAVYFCARESMGAINDNWGQGTLVIVSS

SEQ ID NO: 364 - protein, 110 aa, Homo sapiens
QSALTQETSVSGTVGQKVTLSCIGNNNNIGSHAVGWYQQISRGAPKMVLFGRSPPSGVPDRFSGSKSGTTASLIISGLQPEDEADYYCSTWDSSLSAVVFGGGTKLTVLR

SEQ ID NO: 365 - protein, 110 aa, Homo sapiens
QSALTQETSVSGTVGQKVTLSCIGNNNNIGSHAVGWYQQISRGAPKMVLFGRSPPSGVPDRFSGSKSGTTASLIISGLQPEDEADYYCSTWDSSLSAVVFGGGTKLTVLG

What is claimed is:

1. An isolated anti-hGM-CSF monoclonal antibody or antigen-binding fragment thereof, said antibody or antigen-binding fragment thereof comprising:

(a) a heavy chain comprising a $V_H$-CDR1-containing sequence, a $V_H$-CDR2-containing sequence, and a $V_H$-CDR3-containing sequence, wherein:

(i) the $V_H$-CDR1-containing sequence is SYGMH (SEQ ID NO: 4), (ii) the $V_H$-CDR2-containing sequence is LTYHHGNRKFYADSVRG (SEQ ID NO: 5), and (iii) the $V_H$-CDR3-containing sequence is ESMGAINDN (SEQ ID NO: 6); and (b) a light chain comprising a $V_L$-CDR1-containing sequence, a $V_L$-CDR2-containing sequence, and a $V_L$-CDR3-containing sequence, wherein:

(i) the $V_L$-CDR1-containing sequence is IGNNNNIGSHAVG (SEQ ID NO: 7), (ii) the $V_L$-CDR2-containing sequence is GRSPPS (SEQ ID NO: 8), and (iii) the $V_L$-CDR3-containing sequence is STWDSSLSAVV (SEQ ID NO: 9).

2. The antibody or antigen-binding fragment thereof as claimed in claim 1, wherein the antibody or antigen-binding fragment thereof binds to human GM-CSF with a $K_D$ of less than 400 pM.

3. The antibody or antigen-binding fragment thereof as claimed in claim 2, wherein the $K_D$ is less than 160 pM.

4. The antibody or antigen-binding fragment thereof as claimed in claim 1, wherein the antibody or antigen-binding fragment thereof neutralizes hGM-CSF activity, such that the antibody or antigen-binding fragment thereof has an IC50 value of less than 100 pM as determined in a TF-1 proliferation assay at ED80.

5. The antibody or antigen-binding fragment thereof as claimed in claim 4, wherein the IC50 value is less than 30 pM.

6. The antibody or antigen-binding fragment thereof as claimed in claim 5, wherein the IC50 value is less than 20 pM.

7. The antibody or antigen-binding fragment thereof as claimed in claim 1, further comprising a signal sequence.

8. The antibody or antigen-binding fragment thereof as claimed in claim 7, wherein the signal sequence is selected from the group consisting of SEQ ID NOs: 324, 325, and 326.

9. The antibody or antigen-binding fragment thereof as claimed in claim 1, wherein the heavy chain is selected from the group consisting of gamma 1 ($\gamma_1$), gamma 2 ($\gamma_2$), gamma 3 ($\gamma_3$), and gamma 4 ($\gamma_4$).

10. The antibody or antigen-binding fragment thereof as claimed in claim 9, wherein the heavy chain is gamma 1 ($\gamma_1$).

11. The antibody or antigen-binding fragment thereof as claimed in claim 9, wherein the light chain is a lambda light chain.

12. The antibody or antigen-binding fragment thereof as claimed in claim 1, wherein the heavy chain has the amino acid sequence SEQ ID NO: 46.

13. The antibody or antigen-binding fragment thereof as claimed in claim 12, wherein the light chain is a lambda light chain.

14. The antibody or antigen-binding fragment thereof as claimed in claim 13, wherein the light chain has the amino acid sequence SEQ ID NO:36.

15. The antibody or antigen-binding fragment thereof as claimed in claim 12, wherein the light chain is a kappa light chain.

16. The antibody or antigen-binding fragment thereof as claimed in claim 12, further comprising a signal sequence.

17. The antibody or antigen-binding fragment thereof as claimed in claim 16, wherein the signal sequence is selected from the group consisting of SEQ ID NOs: 324, 325, and 326.

18. The antibody or antigen-binding fragment thereof as claimed in claim 1, wherein the heavy chain has the amino acid sequence SEQ ID NO: 51.

19. The antibody or antigen-binding fragment thereof as claimed in claim 18, wherein the light chain is a lambda light chain.

20. The antibody or antigen-binding fragment thereof as claimed in claim 19, wherein the light chain has the amino acid sequence SEQ ID NO:36.

21. The antibody or antigen-binding fragment thereof as claimed in claim 18, wherein the light chain is a kappa light chain.

22. The antibody or antigen-binding fragment thereof as claimed in claim 18, further comprising a signal sequence.

23. The antibody or antigen-binding fragment thereof as claimed in claim 22, wherein the signal sequence is selected from the group consisting of SEQ ID NOs: 324, 325, and 326.

24. A pharmaceutical composition comprising the antibody or antigen-binding fragment thereof as claimed in claim 1, and a pharmaceutically acceptable carrier.

25. A kit comprising the composition as claimed in claim 24, and one or more containers containing the composition.

26. A kit comprising: (a) the antibody or antigen-binding fragment thereof as claimed in claim 1; and (b) one or more containers containing the antibody or antigen-binding fragment thereof.

27. An isolated nucleic acid encoding the anti-hGM-CSF monoclonal antibody or antigen-binding fragment thereof as claimed in claim 1.

28. The isolated nucleic acid of claim 27, wherein the nucleic acid is a DNA.

29. A vector comprising the DNA of claim 28.

30. An isolated host cell comprising the vector of claim 29, wherein the vector is an expression vector.

31. An isolated anti-hGM-CSF monoclonal antibody or antigen-binding fragment thereof, said antibody or antigen-binding fragment thereof comprising a heavy chain variable region having a heavy chain variable region sequence and a light chain variable region having a light chain variable region sequence, wherein the heavy chain variable region sequence is SEQ ID NO: 348, and wherein the light chain variable region sequence is SEQ ID NO: 365.

32. The antibody or antigen-binding fragment thereof as claimed in claim 31, wherein said antibody belongs to $IgG_1$ (λ) class (subclass).

33. A pharmaceutical composition comprising the antibody or antigen-binding fragment thereof as claimed in claim 31, and a pharmaceutically acceptable carrier.

34. A kit comprising the composition as claimed in claim 33, and one or more containers containing the composition.

35. An isolated anti-hGM-CSF monoclonal antibody or antigen-binding fragment thereof, said antibody or antigen-binding fragment thereof comprising a heavy chain variable region having a heavy chain variable region sequence and a light chain variable region having a light chain variable region sequence, wherein the heavy chain variable region sequence is SEQ ID NO: 361, and wherein the light chain variable region sequence is SEQ ID NO: 365.

36. The antibody or antigen-binding fragment thereof as claimed in claim 35, wherein said antibody belongs to $IgG_1$ (λ) class (subclass).

37. A pharmaceutical composition comprising the antibody or antigen-binding fragment thereof as claimed in claim 35, and a pharmaceutically acceptable carrier.

38. A kit comprising the composition as claimed in claim 37, and one or more containers containing the composition.

39. An isolated anti-hGM-CSF monoclonal antibody comprising a heavy chain having a heavy chain sequence and a light chain having a light chain sequence, wherein the heavy chain sequence is SEQ ID NO: 46, and wherein the light chain sequence is SEQ ID NO: 36.

40. A pharmaceutical composition comprising the antibody or antigen-binding fragment thereof as claimed in claim 39, and a pharmaceutically acceptable carrier.

41. A kit comprising the composition as claimed in claim 40, and one or more containers containing the composition.

42. An isolated anti-hGM-CSF monoclonal antibody comprising a heavy chain having a heavy chain sequence and a light chain having a light chain sequence, wherein the heavy chain sequence is SEQ ID NO: 51, and wherein the light chain sequence is SEQ ID NO: 36.

43. A pharmaceutical composition comprising the antibody or antigen-binding fragment thereof as claimed in claim 42, and a pharmaceutically acceptable carrier.

44. A kit comprising the composition as claimed in claim 43, and one or more containers containing the composition.

45. A vector comprising a DNA sequence encoding a heavy chain of an anti-hGM-CSF antibody comprising a $V_H$-CDR1-containing sequence, a $V_H$-CDR2-containing sequence, and a $V_H$-CDR3-containing sequence, wherein:

(i) the $V_H$-CDR1-containing sequence is SYGMH (SEQ ID NO: 4), (ii) the $V_H$-CDR2-containing sequence is LTYHHGNRKFYADSVRG (SEQ ID NO: 5), and (iii) the $V_H$-CDR3-containing sequence is ESMGAINDN (SEQ ID NO: 6).

46. A vector comprising a DNA sequence encoding a light chain of an anti-hGM-CSF antibody comprising a $V_L$-CDR1-containing sequence, a $V_L$-CDR2-containing sequence, and a $V_L$-CDR3-containing sequence, wherein:

(i) the $V_L$-CDR1-containing sequence is IGNNNNIGSHAVG (SEQ ID NO: 7), (ii) the $V_L$-CDR2-containing sequence is GRSPPS (SEQ ID NO: 8), and (iii) the $V_L$-CDR3-containing sequence is STWDSSLSAVV (SEQ ID NO: 9).

47. A method for producing an anti-hGM-CSF monoclonal antibody or antigen-binding fragment thereof that binds hGM-CSF, wherein the antibody or antigen-binding fragment thereof comprises at least a $V_H$-CDR1-containing sequence, a $V_H$-CDR2-containing sequence, a $V_H$-CDR3-containing sequence, a $V_L$-CDR1-containing sequence, a $V_L$-CDR2-containing sequence, and a $V_L$-CDR3-containing sequence, in an isolated host cell, the method comprising:

(i) obtaining the isolated host cell comprising at least one DNA sequence encoding at least the $V_H$-CDR1-containing sequence, the $V_H$-CDR2-containing sequence, the $V_H$-CDR3-containing sequence, the $V_L$-CDR1-containing sequence, the $V_L$-CDR2-containing sequence, and the $V_L$-CDR3-containing sequence, wherein:

(a) the $V_H$-CDR1-containing sequence is SYGMH (SEQ ID NO: 4), (b) the $V_H$-CDR2-containing sequence is LTYHHGNRKFYADSVRG (SEQ ID NO: 5), (c) the $V_H$-CDR3-containing sequence is ESMGAINDN (SEQ ID NO: 6), (d) the $V_L$-CDR1-containing sequence is IGNNNNIGSHAVG (SEQ ID NO: 7), (e) the $V_L$-CDR2-containing sequence is GRSPPS (SEQ ID NO: 8), and (f) the $V_L$-CDR3-containing sequence is STWDSSLSAVV (SEQ ID NO: 9); and (ii) culturing the isolated host cell under conditions suitable for expression of DNA and production of the antibody or antigen binding fragment thereof.

48. The method of claim 47, further comprising isolating the antibody or antigen-binding fragment thereof.

49. The method of claim 48, further comprising preparing a composition comprising said antibody or antigen-binding fragment thereof and a pharmaceutically acceptable carrier.

50. The method of claim 47, wherein the at least one DNA encodes a heavy chain or portion thereof and a light chain or portion thereof, wherein the heavy chain or portion thereof has a sequence selected from the group consisting of SEQ ID NOs: 46 and 348, and wherein the light chain or portion thereof has a sequence selected from the group consisting of SEQ ID NOs: 36 and 365.

51. The method of claim 50, further comprising isolating the antibody or antigen-binding fragment thereof.

52. The method of claim 51, further comprising preparing a composition comprising said antibody or antigen-binding fragment thereof and a pharmaceutically acceptable carrier.

53. The method of claim 47, wherein the at least one DNA encodes a heavy chain or portion thereof and a light chain or portion thereof, wherein the heavy chain or portion thereof has a sequence selected from the group consisting of SEQ ID NOs: 51 and 361, and wherein the light chain or portion thereof has a sequence selected from the group consisting of SEQ ID NOs: 36 and 365.

54. The method of claim 53, further comprising isolating the antibody or antigen-binding fragment thereof.

55. The method of claim 54, further comprising preparing a composition comprising said antibody or antigen-binding fragment thereof and a pharmaceutically acceptable carrier.

56. A composition comprising an isolated anti-hGM-CSF monoclonal antibody or antigen-binding fragment thereof, said antibody or antigen-binding fragment thereof comprising:

(a) a heavy chain comprising a $V_H$-CDR1-containing sequence, a $V_H$-CDR2-containing sequence, and a $V_H$-CDR3-containing sequence, wherein:

(i) the $V_H$-CDR1-containing sequence is SYGMH (SEQ ID NO: 4), (ii) the $V_H$-CDR2-containing sequence is LTYHHGNRKFYADSVRG (SEQ ID NO: 5), and (iii) the $V_H$-CDR3-containing sequence is ESMGAINDN (SEQ ID NO: 6); and (b) a light chain comprising a $V_L$-CDR1-containing sequence, a $V_L$-CDR2-containing sequence, and a $V_L$-CDR3-containing sequence, wherein:

(i) the $V_L$-CDR1-containing sequence is IGNNNNIGSHAVG (SEQ ID NO: 7), (ii) the $V_L$-CDR2-containing sequence is GRSPPS (SEQ ID NO: 8), and (iii) the $V_L$-CDR3-containing sequence is STWDSSLSAVV (SEQ ID NO: 9).

57. The composition as claimed in claim 56, wherein the antibody or antigen-binding fragment thereof further comprises a signal sequence.

58. The composition as claimed in claim 57, wherein the signal sequence is selected from the group consisting of SEQ ID NOs: 324, 325, and 326.

59. The composition as claimed in claim 56, wherein the heavy chain has the amino acid sequence SEQ ID NO: 46.

60. The composition as claimed in claim 59, wherein the antibody or antigen-binding fragment thereof further comprises a signal sequence.

61. The composition as claimed in claim 60, wherein the signal sequence is selected from the group consisting of SEQ ID NOs: 324, 325, and 326.

62. The composition as claimed in claim 56, wherein the heavy chain has the amino acid sequence SEQ ID NO: 51.

63. The composition as claimed in claim 62, wherein the antibody or antigen-binding fragment thereof further comprises a signal sequence.

64. The composition as claimed in claim 63, wherein the signal sequence is selected from the group consisting of SEQ ID NOs: 324, 325, and 326.

* * * * *